United States Patent 12,790,634 (MOST PROBABLE NUMBER ANALYSIS OF HETEROGENOUS POPULATIONS) - sequence listing, part 35

SEQ ID NO: 27 - DNA, 7234679 bp, unidentified (residues 1-1,808,670 of 7,234,679)
  source 1..7234679: mol_type = genomic DNA; note = Eisenbergiella porci
atgcgtgagccgccgggccttgcggtactggcggtaattcattctcggtatgttcatagctcctgtatctgctcctttcccggcgtcacccgcaaaatgctgtccacattctgcttgataatgccgtattctttcagctctttctttacctcgttatactgttctgacagccgttcccgttctccgtccagctttttatactcggctttgagcgcatacagattggggagcttcttcatcccggcctctttgagcgccctcgccgcagcttcatacaaaataagctggctctcatgctctcgccggaacgcggccttgtctttggccctgtggtattccagcgccacgggcctggtctgcttgtaggtggaaatctgctttatcagcagagccatttctccaaggcggcactccactgctttcagggcagcggcggcttcgtcgttggctgtgctgatctcgtccagcctgctttccaagccctcgtagctctcaatctggtgttccgtcaggaagtttaaggctttggcggcctgcttcaagttgtagagcttcgcccaccgcgcatagcccgccgattgctgcgccttgatattgttttcaatctcaatacgcaaggaaattccctgttccactttacgcttcggccctctgtccacagccagccccttgatacgccgggtaatggcttcttcggtgtagtccacccccaaggttttgcagcgggtaaagcgttcctgtccgggggagcggaatgaaatgaatttcccgcgtttcatctcgtagccctgcgcctccatgagccgcaggaaactgtcaaaatctctggcctgcgggatggccgcgtcaatggcggttttcagctttgctttccagctcttgcccttgcgctgggcgtcccattcggcatagctctttcccttgtccttgcccggcatcaccacggacaggccgtgttccctgcacagccggtcattggtgcgccggatataggcatagctctggcggttggaaatatacttgcgctggtttgccatatccaccgcgcagaaaatgatgtggttatgcagatggcccttgtctatgtgggtggttatcacatagggatatttcccgccaagcacttcatccgcaagctgccgtccgatttcgtgggcctgctccggcgtggtttcgctcggctcaaaggcttgtatcaggtggtgggccagattgttgcctttcttgaacgcctgatctaacaacatttgaaactcaatatccgccgtttcatacgaacagccataggaggaaacgaatagcttttcatcggtcttgtccgggttctcgatgtagtccagcgcctttttcagcgttgacttgataggatggatctttgtaactgccatatctgggccagcgctcccttgatgtcctccacgtcctgcgcgtacacagtcccggtactgttgatacgccttgcgatttggttgacgttgacgccgattttttgaagctctgcggtctgcgcccggatgtcgctggtatccacttggacaacatagccgtcaatcagcattttccgggcgtaggcagaaaaattccttgtgccgatctgggccatcttctcttgaatgagcgtcctttcctccggcgtcacggggacgcgcagcacaaacttccgttttcggtttgccattttctcaccttccttcattcaggggtttggggacttccccaagatacaaacgggaagccgtttgccgggagtgtagccacactccctatgcttgctgtttttcttttcctccactcctaatactctgaaaagctttcaaactacccgcaaaatagcgctttggaaagaaaaatttgcaaaaaaataagaggcctttttgtggcctccacaacacacagaatagagaatattattttgtgtactggtcaataattgtgctgataaactgtgaaaaatgatattcactttgtgtgccttcctctatctgttggttaagagaaaaattttcagttcctaggctctttcggtttgttctatattgtgttgacattactcttatatctgatcaggcttcatggtctgcatatagcgttgttttcagagtttattagcacagaggcttttgaacggctccaggctgcctgccctcatcaagaaacaataacataatttgcccgtgcagcaacggacaaagcgtcttcgcttcctctaccaatactgttatctgcaagtcttactttggctttatcttgactgcttccttcaaatggcatattatagttagaagcagctaaccaaaaggagggctattctgatgatccaacatcatggcttagaatggtatggtgaaggtgcgacattcgctgaggtgtgcaatgattacacgaaagttgaatacaagtgcaatggaataggggttctatatgattatgcgctgttccttggtattgatttgatctttatggactttaattgtacagacaccttccgtgaacccattccaaataaaaatatcattgaaattcgtcattaccaaaaggggcgcgttgaatttgaactaaggaataataaggtttttcatataaaagaaggagaattatgtatcaatgctcttgctaatattcctgcggcctattcttttccctttggatatggcgtaggactaagctgtgtgattgataaggattctgtcgatgcggaaacgcaacagattttttcgtactacaacattgatgttctaaatctgggacgagaactggaattagaaaaaaagtggtttttatgtcgaacgcctcagcgtctgttacatatcttcgatgaattgtacgcggcaaaaggtattgaagggagaaattacttccggatcaaattattggaactattttaccatatcaaacagctgcggattgaagatcagtatgaggcaacgtattatgccaaagaacaaattgaaatcatcaaacgcatccgccaacagctcatagaaaacctcgacaaaaaaatatctatagaagaacttttgcgaaaggagccaatgagcaaggtcacatttcaagctattttcaaacagatttatggcgatacgccctatgcacatatcaaaaagtataaaatgaatcttgcggctgtttatttgcaggaaacagatcaatcaatcacgcaaatagccggtgaacttggatattcaaatattagtaaatttgcgcgagcctttcaagaagtgtttggaatgcttccaaaggattaccgtaaagcaaaaaagtgatttaacttttgggctgttttcttgatttacttttccctttggagtagttagagactgcaaaccggtgtagaatgacagcgtagttagttattactaactacgctgtcattttattttaaggaggtttcaaagatggaacaaacggtgaagaaaaagtttggcattcgcgatattatgacgattgccgcaatgatggtcatcaattttgctattgcaatgataattggtatggttacattgccttttccggtagtatatttgtacggctctgccggaattgatgcatttatcggcgcaatcttttatctggttgcagcaaaccgcgtcaacaaacacggactgttgtttgcatgggctgcggtttatggggtgattcaaggagttatgggttatatgttcttgattccctattttttgattgtagctctcgttgccgaactgtgcatggttggcaagaatacataccaaagtgcggttcgtaaccgaattggctggatggtcaactcaatcggtaattttgtaggttgtgccgtaccgttgtggtggtcctgggacagttatcaggaaatggctgcaaacagtggttttgatgccaacactttaaatatgcagctctctatggtaacgtctcctgcgctgatgcttttgggcgttgttattactgcggttcttgcaatcctcggcacgttgtttggccagcgtctgctcagaaagcatttccaaaaggcaggcattgtaggatgatggccgtatcaaaaagcagacggattgatcgaattgacgggcgcacagttcttttcctgacgctgtgcgcttgtcttgttactttccttacaacaagttttttaggacatggaatttttaccctttggatttgtttgatcctgtgctggtttagtttgtttcgtcaggcgattgggtgcttttcaatttatatggttgcacttgtatggctactgattgaaatgaaatataaaatcagtgtcccatctccactgttgctcagcatggtttacaaacttttgcttccggctatgcctgcctatcttctggctaaaatcccctctggcaaattaacggccagcttgagaagaatgccgatttctacccatatcatgcttgtattgatcgtcatgctccgctttgcgccgactgtgctgcatgaatttggagaagtcagggaagccatgaaaattcgtggcttcttaaaatcggtcggcaatgttttgaggcatccaatggacacgttggaatacgccattgttccgatggtgttccgctccttaaagatcgcggacgagttagcagcttctgccatagtcaggggaattgaaagcccctacaagaaagaaagctactatgtcagccggatcgctgtgctggattgcgttttgattgttgtcagcgtgggagctgccgtgtgctgctgtcttttataggaggaatggaatgggaaaagaaattatgatccgtgacctgaccttttcctatggcgggaacggaaatcaactggaacatatatcattagacattgccgccggggaggtcattgttatgaccggcccatcgggaagtgggaaaagctctttgacaagagtaattaacggcctgatcccctacttttacgagggagaattaagcggtgaggtttttgtggatggaaaactgctgaaagagattccttcctgggaacgcggcaaaatcgcaggaaatgtatttcaagacccgaggagccagttttttgccaatgaggtcgcaggcgagattgcttttggctgtgagaactacggttattcccatgaggaaattcagaaccatgttcaccgggcagcggcgaacatcaagattcaggatattttggatcacagcctgcacagcctgtcctatggaatgcgtcagaaggttgcgattgcatccgcagaggcgattgatcctgaaatctatgtcatggatgaaccgtctgccaatctggatattgcatctacctaccgctttgcagatattattcacgatttgaagaagaagggaaaaaccatcattatagcggaacaccggctttattatctgatggatctgacagaccgtttcctgtgtgtccagaaagggaaaattgtgcgggaatttactgcacagcagatgaaagctctgactaataaggaaatccaggcgctggggcttcgcactcctaacctgcatcagattgagcagacggaaatcccgtctgcggcaaccagtgaggttgttctggaagtgaaaaaactgaaccactcttttggtgaaacgattgtatctaaggatattgactttcaatgccataagggagaagcgatagccctgatcggcccaaacgggacgggcaaaagcaccatagggcgaatcttggcagggcttttgaaagagaaatccggcgaagtcgttttattcggaaagcattgtagaccgaaaggccgcttgggaaaggtctggtatattccccaggatttagacagtcagctattcggtgaggatttgcttgacgaactgactaccggtgcagaagtcaacccggagcggaaacaagcggcggaagaaatcctggaggccctggaactgacgccattcatcaaacagcatccctctacgctgtcaggagggcaaaagcagcggctggctcttggcgtggctctaatgcacgaagcgccgattatcgtactggatgaaccgacaagcgggctggacggtacgaatatgcggaatgtcagccggatgatccgcaagctggcgaaaatggggcgcaccattatcgtcattacccatgacgcggagtgtgcgcttgcctgctgtgagcgggcaatacgcctggagaacggctgcattaccgatgattttcaaatcagaggcgcagagcttctcttagacaaaattggatatgacaaaaaggagggttagaaatggcacagcaaaacaagaagcagccgaaagcgaaaaccggactggcacgctgcctggaactggcttccggccataaagggctggtgttcctggcagggtttttggcggcgctggctgcgatctgttcttttgttccgtacttatcaatctactacatcattcgggaaatcctgtttgtttacccggatatgtcgctcttgaatgtttccgcaatctcgacctggggatggctggccctggctggaattttggggaacatcgtattttacttttttgccctgttgtgttcccacgttgcggcgtttggaacgctttatgaattgaaggtggcctttgccgaccacatcatgcagattccccttgggtatcatctgaccctgggcagcggcaaaatgagaaagatcatggatgaaaacattgaaagtgttgagaaattcatcgctcaccagctcccggactttgtggcctctttggtcgcgccgcttgttctggttatcattcttcttggaattgactggcggtatggcgtggtttgtctggtcggtattgttctggcctttatcgtgcagtttgcgggcttcaacggagaagcaaaggaaaaaatgcaccgttttcagaccgcccaggagaacatgaacagcgcttctgtggaatatgtacgtggtatgtcggagatcaaagcatttaatcagaccgccgattcctttaagcggttgggcaaatccattacagactatacctcttttgtgttggagtacgcattgggctggcagaactgtatgcctgcttttaccacgatcatcaacaatatttatctgcttttgattccggtgggcattctgatcgggatgcacactacggatttcagggagtattcgctgacatttattttctacctgattattgtccatgcgatttccggtgtcctgaataaaatcatgtatatctctgagtcctttacgcagattgacggcagcgtggagcgtatggatgaaatcctgcgtatcccggccctgcccgaaaagagtacggcgcaagcaatcgaaaactatgggattgctttccgggatgtcagcttttcctacgaagccgattcccaggtcaaggccctgtctcatgtttctttctttgcggatcagggcaaggtgacagccattgtcggcccctccggtggcggtaaaagtaccatcgccagcctaatctcccggttttatgatgtgacggacggaagtattcagatcggcggcgttgacattcgggatattcctctggatgcgctgatggataaggtcagcttcgtatttcaggatacgttcctgttcaaacagagcatcctggataacatccgtatgggaaatccagatgcaacggaagaacaggtgattgcggcggcaaaggctgcaagatgccatgattttattgagcagcttccaaacggttatcagactgtgatcggcagtaccggcgtccatctctccggtggtgagcgtcagcggattgccattgcaagggctatcgtaaaagacgcgcccatcatcgttctggacgaggctactgcgttcagtgacccggagaacgagtacctgattcaaaaagcctttgaaaagctgatccaaaataaaacagttgtaatgatcgcccatcgcctgtccacgattcgtaatgctgaccagatacttgtcatggaaaagggctgcctgattgaatccggcacccatgacgagctgctgaagaaggacggaaaatacgcgcagatgtggagcagctatacggagtcgatcaactggaaaattggcacaggaaaggcggtgtgatctatgagtaagctgaaagaaaagctaatgctgtcggagaaaggctattccgacctgaaaaaagcaattacggcctgcacaataaccaatatcgcgttattgctcccatcaatggtagcctgcctgatcttttgggagctgttaaagccgtttacgggagaagcaatttcgtgggccgcgttgtggaagctgctgggcctagggctggtggcggctattctggtattcctggccgcgaaaaacgattataggaaaacctatattgcttcctataaggaggccagcacgaccagacttcggatcgcggagcatcttcgcaagctccccatgagcttctttaacacaaaagatttgtccgatattaccaccaacatgatggcagattgcagtagcatggaatccatgcttagcagtaccatcccgccgctgattgcaaatatcatctctgttaccctgacctgcgtttgtctggcattttttgactggagaatggcccttgcgattttctgcacaatgccggttacattccttatcatcttgtgcgggcgcaagctacaacttcgtctgtttgacaaacaggtggatgtgaaactggaggcatctagccagattcaggaatacctggaaggtatcaaaattatcaaatcctgtggtcttggcggttcccgcttcgatgcgttggataaagcactccaggctatgagaaaaatcgccatcaaggtagaactggcctccggtattctggttcagggagccagcctgatcctgcaagcagggcttggcattactattttcattggaacggtgctgataacaaacggtaaaattgaactgctttctttactggttctactgatgttctctacgcaaatttacggtccgatccttgccattctctcgcagttgacctctctgtttcacttggggactgttaccaaccgtatgcgtaccctgctgaccacgcccaccatggagggcgtggacaaagatgtatccaaatatgacattgaactgaaaaatgtcaccttcggatataaccaggacgatgttatcaaggatgtgtctttctctattcccgctggcagcgtaacggctctggtagggccttccggcagcggcaaaagcacgatttccaaactgatcgcccgtttttgggatgtaagaaaaggccagatcaccattggcggcatagatgtcagcaccattgaaccggaacacctgatgcgctgtatgtcctttgtattccaggatgtgaccctgttcaatgatactgtttttaacaatatccgtgtaggcaacatgaacgctaccgaggagcaggtcatggcggcggcaaaggcggcatactgtgacgaatttatccagcgattgccggacggttatcagactgtccttggagagaacggcagcactctttccggtggtgagcgtcagcggatttccattgcccgcgcgcttttgaaggacgcacctattattctgcttgatgaggcaacagcgtcccttgacccagagaacgaggttttgattcagcgtgctattgcaaaactggtagagggtaagacggttattatgattgctcatcggctccgcactgtggtggatactgaccagatcattgtcctggataatggtaagttggttgagcaaggcactcatgaggaactaatgaagaagaacggtctataccataagttatttcatattcagcaggaaagccttggttgggccgtataatttttgtactaggaggctgagatgaaacttcatgcatccggggaggactacttggaagctatcctcgttctgcataagagaatagacatggtgcgttccgtagatgtagcccggcacatggaggtgtcaaaacccagcgtgtgccatgcagtaggcattttgcgtgagggcggctttctgacaatggatgaagaacactatctgcatctaacagacattggtcgagaagtggccgtaaaaatctatgagcgccattgctttttcatggaacagctcatagccgcaggcgttgatcctaaaattgcagaagccgatgcctgtcggttggaacacgttattagtagtgaatcttttgaacggttaaaagaaacagccgaccaataggaagtgaatcacacgaaacccgcttcaccgcccaataggcaaaaaaaaacgttgcagggacagaggctttcctgcgcgtaaaatagattccttaaccttcggcggttcaagaccaagtctgccgtttcttcgccttctattggaaatggcgtcctgacactggcgtgattggcggctctaggaggaagctgtcatgtgtaaaaagggagatcgaccaccagaaacgggagtagcaccgttaaaaaaagccatcccccggccagtcaaaaatgcggccggacccatgcattatcccatgcagtaaaatatcatactatttttacgttcgcccggagggtttacacccttccgggcgaattttgttgtttcctgcgtcccgtgccaccggccacacattttttcaaaaaatgttgcaaaaagtggtgtttagcgggtagctggcggcttttcaaaagtaactttggcggaaagggagagaaccaccgaaatcacccacagaaagggggtgagaagatggatacgatcccccgcaatgactttatcctgcggcaccgctatgacgcattttgcaaggcggtactccgcaatgaggccaaagattatctgcgcgagatgggacagcagcgcgaccgtgaaaagtcgctggacgccctgacacagcaggaattggacaagctctccacggtagattattaccccagcgacagctacgttttttcgtcgcatggatatgatttgctcattgacaacgagcttgtagccgaggcattcgccagcctgccacaacaagaacaaagcattttgattttgcactgtgttttggatttggcagacggagaaatcggaagcttcatgggaatgtcccgcagcgccgtacagcgccacaggacaagcaccctgaaacagttgcgtttgaaattgatggcgctcatgccagagggagggaaacgcggatgaaggaacccacattcaacggcagaaaacttctgcccctttcggtgatggaagctgcccacgctggggacgcaatggctatggaacaagtgctacggtactatgcaggctacataaacaagctctgcacccgcaccttgtacgacagcaacggcatcccttatgtgtgcgtggacgagtatatgaagcaccgtttggaactcaagctcatccattccatcatcgttgctttgaagtaacggcccggccacggtaacggaaatgttttctaactccctttccgcatttccgccgacctggtggctgatggatgcaccttgacaaatacgcccgcaggacaatggcggtgcgtcatagggcatacggacacattctgtctgtaccgagccggacggcgggtgcgccatgatgctggtttctacgaaaacagcggagcgaccaccacccagccgccacataggcgtggctgcttatgggcgacgacgtgcaggcaggacaatgatactcccttacagccacagtccgagcgttaaaagcgtcgcaggcaatgggtatggccgtgtgagaaccacgcgggggtgaaagtcccgtggagctgggccgccagccgtccgtgttttgcccatagttacaagaatcctttttttgaacataaggaggcaagattatgagtaataacgatgtgcctatttgggaaaaatatacgcttaccattgaggaagcgtcgaaatattttcgcattggagaaaacaagctgcggcggcttgccgaggaaaacccatccgctggctgggtgattttgaacggcaaccgcatccagatcaaacggcaaaagtttgaaaaaatcattgattctctggacacaatctagtgaaaaagagccttgactatgctataatacccttagagtgtgtcaaggctctttccgtcatggaaaggagcatgacgaaatgtcaaaaaaagaacgagatgaaaaaagacgggacagcaaaggccgccttttgaaatctggagagagccagcgaacagacggaagatacacctacaaatatacggatgcctttggagaaccgaagtttgtgtactcatggaagttagtccccacggacaaaatccctgccggaaaacgcccggatatttccctgcgtgagaaaatcaagcagatacaaaaagaccttgacgatgggattgacaccatcggcaagaaaatgaccgtgtgccagctctatgaaaagtacatccggcagaggggcaatgtgaagcggggaacccataagagccgccagcagttaatgaaacttctgtccgaggataaaatcggaggggccagcatcgacagcgtaaagctgtctgacgccaaagaatgggctttacgtatgcaggaaaagggtgtggcctatcacaccatctgcaacggcaagcgttccctgaaagccattttttacatggccgtacaggacgattgcctccgcaagaacccctttgacttccagatcaatgaggttatcaacgacgataccgtaccaaaggtgccgcttacccctgaacaggaaaaggagcttttggacttcatgcagagtgaccccgtttatgccaagtattatgacgaggtattgattctgctggaaaccgggcttcgtgtttccgaactctgcggcctgacacctgccgacctgaattttgaaaagcgctttgtgaatgtagaccaccagcttttgagaagcaccgaggacggctactacatcgaagcgccaaagaccgacagcggttatcgccaggtgcctatgagcgcagccgcctacaaggcatttcagcgcgtgctgcacgggcgaaagaacggcaaaggcgttgtggtggacggatataagggcttcctgttcttaaaccgggacgggctgccgaaagcggctgtccactatgatgccatgtttcagggccttgccaagaagttcaacaaatgccataaggaaccgctgccggaggtcatgacgccgcacaccatgcggcatacattctgtaccagaatggcaaacgcaggcatgaaccccaaggcattgcagtacattatggggcatgccaatatcgttatgacgttgaactattatgcccacgccacattccattccgcacaggaggaaatggaacggctgcaagcccaggcacagaccaccgcagcagtccatgcgcagcctgcgtcagagagcgcccaggaggcccaagccgcataggatacgcaaaatatgtactactgtttgtactacgtttgagagcggaaacatgaggggtaataagaatgtttgtgaggttcttccgataggaaaagtgccggaaaagcccgaagttacgggctataccggcatataagaaatcctaaagagataattggaaatctattaaatgattctttctaaatatactatgaaaattactataatttttatatcctacctgttctgcaatctcctttatcgataaattgctatcaattagtaaaggaacggcaatatccatacgacaattaattatgaactgccctacagacacatccatctcttttctaaataaacgattcagatataccggatgaaaatagaatttttctgcaattacattaacagacaatccctgatcatctatatgttctctgatatagtcagacacctcctttatagcttcatctggtctgcgtttatcaccgaatttttcatcggaattttttattctttccctgacaaactcttttcccagcttctgaaacctgatatcatcacgttttctgtagatacgttcaaccaccttagctattgcagaaccaatatcctcatttctagcaggaagcagaatataatcctggcaacttaaacttattgcctcttttgcatatatgaaattagcatggcaagtaagaaaaatacattcaatttctaaatttttctgccgcacccaccttagtaactcgattccattttctcctggcatttctatatcacacagaataatatctactttcttttccagaataatctgtttagcctgttcagcatcgtaagctgtaaatacttgaacgatctcatagtcttcccatatgatatcttctttcatagtttcagcagttaatatttcatcattaactatcaacagattcatcacattcctccaaatcatacggaaaacttatcgtaatactagttccaataccaatttctgatgatatttctatgttggcattacttccataaaataatttcaatcttcgataagcatttgccatcccgacattggttccatcaattttctcactacgcatttttaaatccacagcccttacttcctcttcactcattccttccccatcatcaactacaatgaatgtgactgtaccattttgatattgtcccattaggctgatatgtattacttttccttgttttaccacatgttttataatattttcaacaaaattatgtatcaacaacggaggaattcttacgaacataatctctggatcataatcataactaatctctatccctcccggataccttacctgtgccatatttatatatccttcaattaccttttgttccttcccatataattccaaatctttgttgcttctaaaaatatatcgaaaataatcagaaagatatagaataatttcctgaatatgaaccatatcatttttttgagataacatataaatcaaattaaatgcatttatcaaaaaatgcggtctgatctgtaattggagattccttatttcagtcttttgcttagacaattccttctcataattttccattctaagtttcttaatactttcggccatcacattaaaagaatcaaaggaactttgatattcgattgaattcgctttcttagtaatccggtaatcctgattaccgttttctaattcaacgtgagccatattaacaatcttaagcggatttatcaaaagacgggcaatcaggaaatagaaaattgggattagaataagagcgaaaaaagctgcaaaccgcatgacagaatacattctataaacagtaccatttacatcattcctgtctattgccacgttaaaatacaatccagcctttttccaataggctgatactaaaatagcatctttgccagcattattcctttctttcttcgtaaaatcaacctctaacacagaatactgcagatcattcttcaatgttgccctagcttcatccaattcgataaatcctccataatataggtcggtaattttaattacctgccaaagtaccggataatctgttttctttccactaccaggtatcatagtcatacaccagccggtgcgggcgttcttgatcatttcgctttttatgtaatactgcatatctgccttcgtatgtcttgatgtattcttatcccagacaagaatatcatcaagaattcccatataataaaaagcgccatccgttacatttcctaccataaaaatatcattgaaggatttaaaaaacttatattttgcgattgtatattcataatccccttcctgtttagccataatcgttgcattagtgtcatttttttgcatggtataaagcaaatagcctatttcatccattcgctcttccacgtcttccatataattaatcattatattcaaaactgtctgtttcgcctgttgttcaacattcttcacagctacactgcttaaaataattgccagaatatttaaaggcaaaaccattatcagaataataataaacattttcgtggagattgatctcttcatatataacacggtgtgtctaaattcccgttgcctttttattgaattcatctatttctcccctcatcataagaaatgcaaaaatgcgcagggattctctgtattccctgcgctgtttttatgaagttcatataactgtgtaatttcttcacagttacattcaaaaatacacttaaaatatcgaagacgacagacttcttccctttttcactccttaacaccccccaacataatgcccttaacaaaatattgctgaaaaaaaggatatataatcagaattggtagaattcccactgttgcaattgccatacggattgttgtagaaggcattttaatattacttccactaaggaacatggcattctgctgaagtgctcttatattttcattaatattattcaatattacctgaattgtataatatttacttcctcccctttctgtaagataatacaacccgttctgccagtcattccaataggaaagccctgtcatcaaaccaatggtagcaactattggtttgctaagaggcatgacaatccttgcaaataccagaaattctccagcgccatctaaatatgccgcttcaatcaagctttccggaattccatttttaaaatagttgcgtatcaatatgacattgaatgcgttcataagtaatcctggtaaaagcagagcaaaaatagtatttttcacatggaaataattaacataagagtagtatgtagcaaccagtcctccattaaaaagcatagtaaaaattgtcataaaacttagaactctcataaccggaatttcatcttgacaaatagcataggcaaaaagtgtggtaacaatgaggctgaaaccagttcctaatatggttacaacgaaagtcataagatatgcatgaccaatcaacgcatgttgtccccaaatatatttgtaggcatcaatacttaatttttcagggaaaaaactaaacccattcgccattgcccaggaattatccgtcaaagacgcaataatcagtaataaaaaaggcagaaaaactaagagcgaacccaaggtaagaactgtatgagctataatctgcaccaatcggtattctcgtgatttcatatgcttccccctaaaataaggcactgcttcgttcatatttccgaacaacagcattagccgaaacaatcaaaataaaacctactattgattgataaaaactggctgcgctcgacatggaataatcattgtttctcattagagcctggaaaatatatacgtccagagttctcgttacactatataaggccccactgtttctgggcagctgataaaacaaaccgaaatcggagcggaaaacctgccctatatttaaaacaaaaagtgtaatcactgtcggctttaaaagcggtaaggttatataacgaatttgtctccatttattagctccgtcaatacgcgctgcctcataatagtcctgactgattccaacgatactggataagtatacaaccatactgtagccagcagttttccataggtttacaaatattattataaacggccaatactgtttctgttgataccaattaatggtatgcatacctagcggtttcaaaatagaactgttaatcaatccggtttccgcagataaaaaaacaaatgtaagataactaacgataacccagctcatcaaaaaggggagtaaaattatagtctgatatgcctttttggcaaatttattttttacttcattgactagtattgctaatattattgataaaaccgtaccaaaaataaaaaaggcaatgttatataaaaccgtattccgtgtaataataaaagcatctttggatgcaaataaaaaattaaaattttttaaaccgacccaagggctgtcccatattcccaaacggaaatctatatttttaaaagcaattataacgccactcattggaatataattatttaccagtaaataaataaatccgggcaacgccattatgtaaaaagggaaccttcttttcagcttatattttttctttctatttattgatatgacccctgttcgctgtcccatgttttccaccatcccgcaactcaaatttcatttattggctatgaactgccttctctcagtaccacgcctgataattacatgacgtggtactgaaccatcttaaaagaaggagctgtgtttctgcatcctatttttctttatagtttgccgcccattcatcaagttgtctttggttctctgcaattacagcatcgattccagcatctttaagggcctttctaaattcaggtaatgcttcctccggattgaccgcacctgcatccaaactatctgaatactgctctatcactgcacttaccgctgaaaactcagtagatacatcggttacgtcaaagttatacccatttgcatctgatcttctggaatcaggaattgcttcattccattcccttaaaacctggttcatattaagcggcatgggttcaagaaccggccattcaagtcttgatccatatacaccatagggcatataataaggtaatgttgtaggatcatccgcaaggaattttatcagtttatctgttccattatcttcgattacttcataatcctgtccttcaattccccattgaagcagagttgtagcatcaatattttccagcagataatttaacgtttccacagctttccccggatacttggatgttacaggaatctgccagctaacagcagctgagcttgcaggtacataggtaggaattgtagtaatagcaacaagctcataaccgcaggctcttccagactgaatcacaccattgggagtagtccagcaaaaataacccaaataattacctcctgacatcaggacattaggatcctcagtattcgtcgccgcatcaccggaaatatagcctttctgagcccagtcatacatcagatcagcgaatgctttatactcctcagtttcataaagattttccacttttaaatctgtaaagcttctattaagcatcattacccctgaagcggtagttgagcctaaagtatcaagttccatataagatccatgtagcgggaaattcggatccagggccggaatctggcaaaagaaattatcaccttcgcctgcctttaccttagcaaatatatcttccatctcctcaactgaatatactttatctgagtctatttcaattccgtatttttcaagaagatccttacgggctatgtaaccaaatgcgttgccgtccacatccgtcacgggtaccgcataaagattcccctgcagatagcagccctttatcttttcaccacacttttccttaatggcatcaccatattgttccacatattcatcaattggctgaattaatccgttagaaacattgctctgcagactgcctcccacattcagacaaatatccaactgttctccagaggataccgcaagagtagtcgcattagttaattcctggaaaatgaccggttccagcgttacatggacgccgatatctttttcgagcatactattcaacgcatcttcaaccgcctggaagcctgttccagtagatcccatagatggccattgcataacaatgtttgcaatttcatctgtggaatcatccattgtattgccttccgatactgtttctgttgacactgtacttttatctgttacatcagacgtagctgtcgtatttccgccgcatcctgtcagtagtgatagagccataataccggttaatgcaaatgataatacattttttttcatgttatccctcccaatggtttttgtatgtcagttaactgataaataaatcttaacaaataattttcatttttaaaataatcatttgaaaccatgatattaccttttgaaactacatatgtgtacaaaaaaaccttttggaagtatattcacatcttccaaaaggttcgaatattattactcacagtagctaggccaacgactatcaactttaccgtttttcatttttctaatcttcacatatatcattcgcttttgccataacagctattccaggcttacccggaagaattatctcagtccttccctttgcttttgtatttactatcgttcttgtcatttcccaaacatcaatgacttctactgtaaattcttttgtttcaggaagctccatcaccgtatatatcgtacatgcatctcccagataagtcagccatactttatccccacagtgaagtatgggctgtgtaaaaaactctttcatatactcaaattcatcttcttgcattttagccatacacttaaataccagattatctgcaattccttttgcaccttctgctactaatgactttagctcgtcctgggtttcaaaaggaattccagactctggatggtataaatctggtgcctgaggcatgctttcaaaaattttccgcataaatgcaattcttagcacactttctccctttaaaataccgcctttgctccaccacaggatctggtcatcatccatcttttccatataagtttcgccgtgactggcataaccccccatacaaaacgtcttccaaaaacggttaaccatttcaaaagcggaaatatttccccaactatatgggatattaccctcatagcccatttcatcataaatcacaggttttccataacgcttcagcaacaccggaattttcacactatctgcactctgaaggcaacaatgggtcgtataaggattagaaaagtcccatggatgtacaaaattatgattgcttaacaaatgatgataaagatcatttttaccaatgtaagcggcaaaattttcccaatcttcctgtttcaaagaatcaaactgatcatattcatttgccaaagaccaccatatgttgggatatgcagaaagacgcctaagcacataatcaaagtagaccttgtattcttccggagtcagatgcataaatccccaacagtcatatggatgtaacaatatcaaatccgcttctataccatattccccaagctgctccaatcgtttatccaatatattccagaaagtgaaatccggttttcttacattccacttcccaccttctgacctttcaaaaggatagacttctggctcatttctattaaaatcaaaaaactttgggaaaatacacattctgactttattaaaaggtgcctttttcaaagtttccatcgtttgatccactaatgccttatcctgatgaagaagcgcatatactgttgtcccgaaaggcagataaaccgaaccatcatcatattgaaaatgctcttgtatagttctaacaggcccatggttcctggctactgcaggttctacatatgaagaaccgttcatctctgcttcaataaactttatcgaagtttcaatctgccagttacatatcccagtttccaaaggcaaatacctgatgcagtatcttccttcacctgtataaaaacctttcacacagacagtctttccattttgagaaaaatatgcctttaaatttacatcaacataattatctgctggttcttcaccaaacaacttcaactgaaatatttcgtattgttgcattttatttctccttgtatttaataaatataaatacatcatatcaaaccaactattttgttcaataacaatttaaaactaaattttaatgttttgaaacataattctatcattatatataaatcactatcaattataaatacttttactcaactatgacccgaaccctatccagattcttgcattgtgtaaagatatcccccaatcgtccttctcggttgctcttaactttaatcaccgggaaaaaaacacctggttggttaaagcaatgcaccgttctcacccaggctttttcaccatttttagacagttcaagctcctcctcatgggaaaaatcattggtcttctcataatcccatgatgccgcagtcaccttacccgtccctcgtggcacctcgatttttgcagtaaagaccacttcttctccgacctttactttgacacacttaacaccattcgcccaggcatgaactaccggctgcagcccgccccgttcgtctgcgctgtctggcacttcaatttgtccatcgttaaatatataattcgtacttggcaccggggcaatacccctttcacaccagtctgctaaatctaacagtacctgaaacagaatacacgcataatcaacttgatgttgaggatcctcctggtatccgacaagatcattatgaatacagttatcattgtaataaagacggaaagattcatcggttttatctcccagatgtctttttaccgcattaaaataccagtctccatgccatgccagcgcactctcgtccagaatagagcacaatgcaattatctttccatgaatatctccgctgggaacgcttcctcccccattctgtgcaataattggagctatcaaaatcggcagctgcgggtacttcagtgttccgttgtcattacggtattgatcatagaccttataggtcttgtcgggtacctgatgacgttgcagcgtctgcatcgccagataatcactgttgtcgatcataatcttatcgcctacagcaagatctgacaattcgttttcctcaccatttgtacgcccaatagttatcactccatcctctattttctcaatgacctgttcttttcctacttctactccgctcaaaacacgaagtcggcagtgaatcagatatgcattctctggcggcagaagctccatgcgtatccgtggagcttctaaattgcccttcaatgaatatttccaactggtatcaacactggaaaccctgttgctgtcatcctccttcttcacttcaatcaattcctttacagtcgtaacaaaccgcactctttctctgacttcaatactatcaggattggttccttcatagccctcttttgtccagaaatctgtaaaatattgcggatacacattataaatagcaggtgacagtaccatcagtgaaccatctcccataaaagaactacagaaccagcctcgttttggaaatcccattctagtcgcttcttctaaagcttctgtttgctgtgcagtaagtccatcataaagatttccgcttccgccaggttccatattatcaataaccttcgccattccgctttcacctaatacatgcatggcacgaactctgggacagaatacatttggcgttgccatagggttggcaattacatagggaacccctccatcccataccccttctgtcatttccatacaactgatagtcttaaagctgcctccgcttcctccgaaaatatagccataaggccgatgctcatacccgtacaatttctgcgccagtttgcgcccaagcagcgcactgctggcgctggttctatacaaacggcttccatctccaccggttacaaaacccccttgatttgtaactacataataagctccatggcttacgaaaaagttgattttgtcatctgccccggtctggttttcacacatccgctcatcctctggagccgcagagacatactggtaaaatcgctcttcatatttcagcttttctggaaaataaaaacagaaccgtgcctcatttgttccatctatctcggtacctttaaaacctccatgaatataataatgacgtaccggcttatctcgccattcttcaacatcaatataggggtttgaaaaatacatatcttcctccggtatgtataatcttttttctttcattctgctacctcacttttattttttatgattttcactgctattacttcatctgatttctgatagaagcttatttccttcttctctacttatctcaccactgttgattttcatataaattcggattttctcacgttttactctaacgaaacagaatgccacggctgcaagcgcaaatccaataatcgggaataggtaggtaacattccacagccccactatagcccggtcagtctgcaggccaattccctgctcattcagttttgccagttcatcaaaggagctggcttctaccgagatgaatccatatgcaccaaggataaacagtgacacactggaaaccagagagtttaccagcttgccaacgaaacttcccaccgcggaaataatacctcctgcgtcctgtccggtacggtattttgccatctccaccaaatcaggcgtcagttgtcctccgctgaacattgtcattacataacaggttgactgaatcagggaaaccaaacacagtatcggaatatttgcccggaagaaatccggaccgagcagacagataatcacaccagtaacagcaaacaaagtacaggctgctcttgccacaacaatcttatccaaatgcttaaaaagcgacggcaggaaaggcaaaagcaatatagaaggaagtacaccaaccaatgtcaaaataatactcagaccagcatcattaaaaatataatacgccacaaacatcccataacttgtggtatagaaaataccccagcaaaatatgccaagcagaaggaaaaacagttctggcagatgttttaaagtagtaaacatttctttaatagtatagttcttctgctcttcaggattaacagcagatacatttctttctttcacaaaaacggctggtatcagcgctaacaaaattccaagaatagaaaagattaccgctgctcccaaataaccggtttttcctgcaatcatcacagttcctaaaaatactacgggtaatgaaccaatcccctgccctaatccattccatgaaagaacgaagttgcgctcatcaaaattatttgttgcggaaattggaacaagtgtaaaagctgctccaaccgtcattcccatatcatacagaaggtatccaaaaatatactgtgccacacgaatccacagcggcaactttgtgcttatagtaaaaattataattgttcctattggaatcaatagaaacagtatccgaaaccagggcatatattttccggagaacagccatctggtgaaggcattcttctttggtttaaaatgaattttatccattaaatatccaaatagtacatcgttaaatgcgtcccaggcttttaaaaataacatagcagtcgctgcaattgcaggattaataccaaccatcaatagataaattgacataaatgaggaaacaaatgtatttcccgcctgatatgagccagcaccgaaaaacatggcaattttttctccccaaggaataacccatccctcattacctttctttttacccattttctttttcctccttttcatacctccacagaattgtttcaaacacaataagagtttgatttgttctattactataaagttttttggaaaaagtgaatatcaatatttttgtttccatgttaaaatattggaataatatttatgtatggcatagtggggtaacagatgttggaaaatgatattaaacttttttttgaagccacagggattcctgtctgctgttttaaacaaaaagaaatagttactaaatacgatcataatcagcaggatttcaaccttcccctatttcttcttacctgcatacaacaggaaatgccgaaggtatggtattcttttacaccggaatatatgtatttcggcgggatttataataaagagacgggacagactctgtttcttggtcccgtccttattacagaatgttccttgaaacaagctgaaacaatctgtctgcggcttggacggtccggtaaagattcatttataattaaacagtgctttgacaatactcgtcctcacagtgttaatgaacttcttgccgggctgcatctactctgtcggcttcttcagtgggattttcccgacaatgtcccgtgccttcttttccaatgggatacaccctatccaatccgagcggttcagcttccactttctgttagcgataccgttttcagtgacacggaagacaaaattatgtcctgtatccaggccggaaatgttatggaattaaaccgtatcttaaatgaacagataatgttctcttccgattatatgcctcttagcctgaatgatcagcgtgtttgtatcctgggtgcaaatatgctggcctcccgttccgctatccaagcggggttagattatcagtttgcatgggaactctgttgtcaatatatttccagcattcttaaagccaggacaagtgatgagctatcttatatcttccttaggttatttcaggactatacacaaaaagtagcaaacctgaactcattaacaggctcacctattgttcgcaaaatataccaatatattcagcttcattttgacagtccaattacactaaggatccttgccgactacctgcatatgaattgctcctatctgagttccctttttaaaaaagaaaccggaattactctcagtacttatatacaacaggaaaaaatccgggaagcaagacgtctgttaaagggcagtaaatttacgataacacagattagtgaggcacttgcattctcttcccaaagctatttttgtgctgtttttaaaaaaataaccggtatgactcctgagtcataccggcattctgttgaataaattttttccagttttattttttacgctgatatccagctggtgtcataccagtatattttttgaaaacggcacaaaaatagcttgtggaagaaaaacccagcagttggctgactgatgtaacagtcagtgtattctgttttagcaaatgcatggcttcttctacctttcgctcctgtacaaaatcggtgattgttttgccggttgcctttttaaattgtctgcacaaataagaaaggttaacgtttaattgcctggacagcagagtcggagtaatattttcatagagatgggaaacaacatacttgttcactctttcagccatcggggaatccgtttgcagtccctttaatgcagcaacctggcgggtatattcccgaataaattccacaaagatatatgtcagttcggaaataccggatgcctgctggattctgcgatcatattgttcaaacagtgcagtgacaagagaaatatccaaattggcatgaagggcaattctggaacagaagaaattggcactgcacataatatgggttctgttccgaaaaagctgcggatcatccatatcctcttctcttctaatcaatatctggtttaaaatcatatgttcgagcagatcacttcttccgttctcaatacattccaccagttctttttccataggtatggctcctgtatttccaggctcagggatgcaataagcggcaaaatgcagtgtagaattccagcgaaactccaactgctgaggtgatgtgcagtcattgagcaggagtcgctgcagcagcttgagtccggactggatagaaactgcatcacaggaaccaactgaacgaaaaaatcgaatcagttctgatacatcctttcgtttacggccaatccgatccaaaatacgtgacgcctgttcccgggaacattccataacgtaggctgggccgataaaaattgtaatattttcttcagcaatggtcagaccagccatatacataaattccggtgaaatgctgtaccagaccggcggaagtacccgcggaaggcaatccaaaagcagcattggaagattaaaatcgatttgaaaatccattgttctttttacaagttcgtgccctttaaaacaacttacaggcatatgtgttgcacggctgtaatcatcaagtaattcaaaaatttcttctattttcataaagcagtcatttcctttcagaattggtttgcaaattatcactgccaatactgcagtcacagatttataaaactatatattatattatttcttacattttttacaatatagtaacatacaggtaaatataatgatatccgaaatttcatttttctttgtaagatatccgcataaacaagtaaatcccgtttatgggtaataaattatgggggtatgaaatgaaaaggaaaaaagaaaaaagtccgaaaaagttaggaattggcagcctgtttgcctggcagagcagagcggtatcccacggtatatgcatgatgattctgggatatttgtccatttattgtacggacacacttaaaatggatccctatcttgtggggatgctcttcgttttaagcaaacttctggatggtgtaacagacgtatttgcaggatatcttgtagatcgtaccaacacaaaaataggccgcggccggccttatgaattttgtataatcggattgtggttttgtacctggttgatgttttcctgttctccgtcctggaaccttgttgtcaaatgtatttgggtattgagcgcttatgctttggtaaatagtatattttttacttttctcaatgcaaattcaaccgtatatatggtccgggcattcaaatatgaggaacaatatgtggcgcttaattcttatggcaacattatcagcatgatttgcgttgcattttttaatgtaatctctcctactctggtcgccaggtatgcggtaaatgcatccggctggagcaggatgatcgccatgatcgctattccaatggtaattatcggcatgatgcgattcgtttttattaaggaaacaaatcaggtagacgtaaaatcagcagatggggagaaagcgaaaataaagctcaaagatgtaaaaactgttctcactaaaaacccatatatttatatcgtcgccctgattctgtttatccagagtttcgtcactaatatgggcgtcaacgtttattatttcacatatgtggctaaggatctgagtcttatgggtttggtaaatgcagcaatgcttctcgcaattccgctggcagcgttctttccgaaaattatcaaacgattttccaccggaaagttgattttagcaggatgcctcgttacagccgccggctatcttcttaactttttcgccgacggaaatccttttcttttgggaattgcaggaattctgtacggtggaggggttactcctatcagtgtactgtttcccctgatgatcatagattgtgccgattttaatgagtggaaggggatgcagagaatggaagggacgctgggatgcgtaaccggcctggccaccaaaattggttctgcgctgggcgccggtctgctgggcatcctgctttcctgcgcaggatatgtgggcgacatggctcaaatgccagaaagtgccatacggatgattcgtttattattcagtattatacccatgcttttatggctggcggtaggcagcagttttctattctataaactggacggaatgctgccgaatatacgcagggaactggaagaacgcagagcacagagagaaacggatattcccggataacggaaggaatatacaaaattctattggaggaagaaacatggaaaaaaagaaactgtacataccatcagaggacgattattattcacagccctacattgatgaagaggaatggagggatacaccagttcgccattattatgtgcatggtgggttcagaggaacggagaaaaacgggattgaagcaagattttgtttctattttcctgaaaaagaaaaatacgaggaacgtttttttcaatatgtgtctcctgcccccggagatgagcatgaaaatgagtggcttcgcggtgaagacgataaaatcagcttttgcttaacccatggcgcctatcttgttaacagcaaccagggcggatttatacccgaggatggggaacgcttatataaaaccagtgcccaatgtgctgagttcagccgaaaggtcgcccggaagctttattgctatgaacaccgtccttatggctacatctttgggggaagcggcgggagctttaaaacaattggctgtatggagatgactgagggcatttggaatgggggcgttccttatgtaaccgcaaatcccatggccgtaccaaatgtttttggcccacgtgtccgtgtgatgagaatgcttggagaggaaaaactgaagcatcttgtagatacaatggagccgggaggcagcggaaatatttacgagggactcgacgatgaacagcggatggctttagaagaagctactaagatgggttttcctaaacgaggatggtttttatggcccacaatggaggacggagctctgatggtactggccccctatatatataatgtattccctgattattttacggacttctgggaaaaaccagggtatgccggagcagatccgaacagcaatgaagcaaaagcccgtattcaatttgaaaccagagttgcagaattgatcggtttccgcaatgatgagaacaatgagaattatagcagtgtggataaaagctggcaaaatatgtctgctggacaggatataacaccacagattcgcatgaaggatatccccgaacagggaaaaaatctttttcactgcagaattaaggtattaagcggaaaggcaaaagggaaagaaaactccattgaaaaaatagaaaacgatgtcattacagttggaaaggcatttgattggagtgactcctatcatgcactgacaggattagcggttggtgataaaatcatgcttgataacagcgattatctggcaatgcagactttccagcgtcaccaggtacccgacgacagctatcatgtatacgatcaataccgggataaaaaaggcaatccgatttatccacagcttccgtttctcctttccccaattattgctaaaaacggcggcggtgaagttcccagcggggatattcacggaaaggtcattgccgtctgcagtctgttggatgaaagtgcctatccatggcatggagactggtaccgtcatgcagtagaacaacatctgggagaaaaaacagatgagatgtttaggctttactataatgataactgcgtacatgaggataatacagagcgactgaatgatccaaaacaaagtgaccctcagcatcaggtagattacctgggtgtactgcatcaggtacttttggatcttgcagactggtgtgaaaaaaacaaagcgcctgtaccatcaaccaattatcggtactgtgacggccaaattgaagttccggatcgtgcagatgaaagaggaggactgcagcctgttgtcaaatgtttcgccaacggacagaaatgcatacatgtaaaagccggtgaaacagtaacctttactgcttcaattgaggttcctaaccatacaggaactgtgactgcagccacctgggattttgaatatacgaatgatttcagcagacgcgaaaagctggaaatgaaagagaacggtcatctggcgaatgtgaaaacaacacatatatttaaaaaacccggaacttattttcctgtgctgaaagcgcaaagcagccgaaccggaactcttgatgatatctatgtacagtgtaaaaatatggatagagtaagagttgttgttgagtaaatctattgtctgtaaacctttcaaaataaatttaggtgattgcgaacttgtttcacaatcaccttatttatatttcaataattgtatagaccgttcctatcagtggtcaattgcattttgatattccctgggagtcctcccgaaatactgcttacactgttccgtaaatagttattgtaagcttgctatcccggagcagatctcctgccagtgtcatatatttacagagaatgaagtcgcttgccgtctgtgtatatcatttttaaaggaatgggtcaggtgatcaggactgatataggccatattagcaagctgactgacactgagttcttccggcagatcttgtttaacgtattccaccacctggtctaccacgttatcccaggacacccggcatctttttcaaaggctatacttcattcgaacaataaatatatatttccaagtattccttccggttcaactggccgctccatcgagcgtggatccataaatgcgtttgctaatgtagtcgccacctctatacgtatctcattcagaccatctatagtaaaatctgaaatattatagctgtagggataaccgattctcactcctacagaatgtccattaataaaaacttcagctgcttcataacagcgttcgagctcaagccggcaggctttcccttcaaattccatctcatatcggattataccggaaaaattcaagatactttttgatatgtcttccaaatttttaacagtcattaataaccggaaacactcttgagaattataatctgctgttgaaattcttatttcaccatcaaatattttcctgattttctctgtcccggatactttcggtaattctggcaaatccttttttctacctgccaacagaaggaaagactctcctttttccatatgaaattgcaggcttctatcctcatttcttttagatagcgaccatatgttctctaccccatgataacatatatacgcttcctcttcctctaccttaaccgctacatccaaggtattcaccatcgaggaattcataaacatatacacacataaatcaggaaatacatacttatagcacctaagccatttattatgcggaaaaatccggcaattacgactctcatcaagcaaagctggtatctccttttcttcgataaccggtatgtttccctcaattatgcttgttaagccttcaggtctggcattcacataaaaaatgtgtgcaccttttctatataactcctccagaagccttatattctcctctggcagatatgcaatactgtcaataagtaaaaaacgataagatgcttttccgactataatccgttcctgctcaacaactgcttctctcagataatccaaacagagaacctcatatgatatttggttttgcagacataacttgcccaaatatccaaagggccggtagcctcctgcccagcatccttctgccggaaaaagtatagcagtatccactatggcccgtccaccgttcaacaaatgacagatccggttcatataattaaataagacatgcatatgacgatactgaggattattcccatgcgcataaaaatgaggtggacagtcctgatcgggaaattccttttctgaaaaggcatggggaacaaaccaattgataccattaaccagcatataatccgccatccaacgcatgagtgtcaacccttcagaccagccaaatgccccgaatatttcgcacattgctcttcctttcatgcgcggattctgatgtgctgccgaggcagcaagcacaggcagagaataatggtagtattcgccactatcataatctctttccggctgtagatcattaagcacaacgtcaattccagccatattctgaccgctcatagccctaaaataatgccccgttcctggccccagtccggaattgagttcaccatcctccatgacatgaccaatatattccacatgccgttcctcacaccacttacctaactggatggaaaaattattttcatacattcgggttatcatgtccatataggaaaaccttatttcccgttcggtaccaccacaattatgaaaaagacctacaagtttcgttttatttcctttatctggacatagctgatctctgagcctatccgtccaaggcaggggcataaggtctcctatttttcccaattcatatggttgtccgcttaaattataaaaacctggctcatcggaaaagaaacctgcaaacgtttccccaaagtcatctttgtatcggcgataatgaggttcatatacggtatctatgagtatcttcactgattccttctcaagtaaagatatgtaatcgcttgctttggatgctgcccccatttttttactataaataaacaagcaataatttccttcaggaatatccatatacaaccatccattaattaccttatcagtcacatcaattagttcggaataatatacacaaccatctttgtcattacgttttcctgcaatcaccgccactagttcctctttaggatcagtctctccaaagcctcccgtctctgtgaagaaccgatcatgaactgcaaatctgcaacctaaaatgggaccatccactttcatcgtccgctcaatcagtgaccaacgttttaatctatccggagcttttctgacagcgccattagcaaatccagtgggaaaatgagaatcatccagaacccatactcgcatctgtcgatttctagcctcttccatgatgatgtccaaatccttccaccagccctcacctacaaaatcagggtgaggccgagattccaggcatacagccctgataccgcagttaaaaatcttttccatatattctcttaggatatcttccgaagaaccatgaagccaaaaaaatggcataatataatttccatagcttccatttagaacgtcctgaagttttttattcatatctgctcctttaacttagccattcatttatttaatacttttatcatttcatatataattataatcttctctattgaagacgcatacctgttttccgacttatactattccttttacgactttatcttctatacgtattcacaaatttattttaatgaaatatattaaattcaccaagtgctctgctgttggggaggcaatggctgaaatatattcattagcttccatcaggtactctgcaacaagccgtttccgaaagctttttgagtttcttttcagcatacttttttccatcctgctccatggtaatccgtcctcaaatctaatacattcattgtcctggccaagtttcaccccacaggcttaattgaaataaacagccactaattaattcctacttttgacactcaaaccagttacttattaggtgattgatttctgaacgcagtatggaactcatattcatacctgtttttatgaaattgggtgggcataatgtacatcttgggaaaaatgtatatgtgaattttaatgctacctttgtagatgatgcaaatatctatattggtgacggaacactacttgcacctaatgtgaccattattactgcaatgcatccaatttcccttaaacttcgtactgagggttacggttataacaaacctgtctatattggaaaaaatgtttggactgcttctaatgttacaattctgcctggagtacatattggagataattctgtgattggtgctgcttctgttgtaaccaaagatattcccgccaatgtagtcgccgtaggcagtcctgcaaaagttataagggaaataactgcagatgatgatatttattacgatcatggaaagctcattgtagataatataatatagaaatttttgatagcctgaaaaatatagcttgccgtagaagaacattgtccatgtttattaatactttttacacttttactaacaaattccagcaattatttacttaaatatgatatgtgcaatatttagcccatatcatttatataaagtgtcaattataaatacccagagaagaaagaggatggtggtttcttctccgggcattttattataaaaattattactgccatatttattcaagtctacggtacataaatttctgctttagaataaaggatagctttaccagctaatattactctatcgttttcaatgcgacaataaagaactccgcttcttttagatgcctgaaatgcgatcaattccctttttttaatcttattagcccacaaaggtataacatgacaatgaccggaaccacacacgggatcttctaatacattcagcttaggtgcaaaacttcgggtaacacaatcataagttgtgccttttgccgtaagttggagtaaaagaccgtccaattctttcagtctttcttcatttggtatagcctgtaaaacctgctgttcatccgccattacacacactaagtcccgccctaaccacgcttctgacgggcgaaaaccgattgccaattccatttcatctgtgactggaacttctgtaagcggataagccggcatatccatttcatataaatcatttaccttttttacaatgagctgaccgctttttgtttgaaaagaaatgctaccactgtctttttcaataaaacgaaataatacatatgccgtacccaaagtggcatgaccgcataagtcaatttcaccgcctggtgtaaaccagcgcagttcatatatgttctccctttttacggtaaatgcagtttctgaaagattattttcttgcgctatattctgcattaacatatcgggaatccactccggcagaatgcagacagcagcgggatttcctttgaaaaccttatctgtaaatgcatcaacaacatactgctttatttccatttaacattccctcctgctaattatttataaaccaatctttgcaaacatctatccacccggaaaaagcagagtacttcactaaggtcttagcaatttgcataggctgacagccaactgcttctgcagcttcttcaactgttgcactcgaatttgcaagtgcaattactcgttgacccaagccaatattttcaaagtattgtttcacattttcaaaagacacatttttacctccttgagtttttctttctgccagtatatactatgcttaaaaataagtaaaattaatgtttattatattaacatgcaaaaaggtaattttaaaaatgaacagatatattgcactccaaaaaatagttgaactcggcagttttacaaaagccgccgatgtattaggctatacgcaacctgccatgagccaaatgatttcttcactggaaagagaactgtctattaaattgctctatcgttccagatatggaattcacctgactttggagggggaacgactttttccctccattcagaaaacagttgccgggtatcagtccatgctggaaattgcaaaagaaattaagggattagatagtggaattatccgtataggaaccatatcaagcatttcttgtcactggcttcccggtttaatcaaacaatttcaagaaatttatcctaatgtgcaatttatacttcaccaaggagattatacgtctattcccgaatgggtgcggaccggagaagcagattttggctttgtaaatcccgacgctattcccggcgttaaaacaaaatttattaagagcggtgagcttcgggcggttttacccgtaacccatcctttggcacagaaatcatatattacattggaaaatctagccaaagaaccttttttgttgttagaggaaggggcgcttagcgaaccgatggaagcctttaagcaggctggcctggaacccgttatccggctatgcgttcatgatgattactctattttatctatgattgagtcggaattaggtgttagtattttaccggagttggttttgagaaaaacgaattatagggtcgctattctccaaatcaaacctgcactcactcggaaaatcggaataattatgaaagataaaaattccttgccgatagcaagtaaatatttcattgattttctttttgaacacattgatgaacttccataaaattcattttaaattacacaacagaggaggactgtattttatattattgtgtcattttactgcacatgagcatgatgctaaatacagaattcctccccatctattcagaggcgatagtaaatataaatatcagtgtgtcataatagtagttattctttatatataaccataatctttttgttatgcaacaaaattaaaactattaattgcttccaaaatcattgtgtaacaattaattgatattaattgaagcaattgaggagattttatatataatctaaaagattcagcaaaaaactccctatcattttcttctgcataaaagcttatcttgtttctttcattaaaatatattcttctgacatctttatcttaaatccttcaccctcaaagacctttctaatcttttccggtaccttcaagtatgcattcatcaaattatcaacagatttgtcatatatattaccctctgtaatcagtatcgcattcgtacttataactggccttttgtgccctgattaatcactcccacttcttctaccgcttcagtagttataccattcgcaccgattaaaataagaaataatataatccataaatatttcattatttaacatccctctatatttatcaaccttggccaacgaatatcaaaaaaagaaggcatcccagaagtcatgtatgacttgaaggataccttcagttctatgagttcttcaacgctggcaggtgacttcgtttccagtaatgctttgtatttccatatgttttttccctcttcctccaaaagagactgtgccagcagattcaacttttctatatcctgaaaactaaatctcatcttttctaattgtgaaataacactttggactttttcaaatctgcattccccaccaatttcagctgacagatattccctgctctctctaattgattcttctctgcatggcaggccaatccaagcttcccgatacccgcctttttctccgacttccaaacatatcaaaatgggacagttggattcttctttaaagttctgtatcttttcatcataaacatcattccatccctcttcaaaccgaaaacaatacccttcctctgtaaaaaccccgttttcctgttcaaccatatatgttcctacttttttctcacttagcaagtcgtaaatttcttccggaaggctttcaagaacaggaagaatatccatttctatagcaaacgctcccagtgcttcttctgaatgtattcctgtataaaattcgaaacactctaaactaaatgcggcattaataagacttctcatagtcagttccggcaaaaaacggagcacctcttcgtacttatatatattagattcatcaaaagtaaaaatatctgttaccaggacattagcttcttttatcgtagattcacaattttctaagatagggataagaaactccggccagaaaaggaattccaggacatggttattttttccacacacccgggtccgttgtaaagcatcttcaatttctgcttttgaggctggcagactgatggcatagccatcgtagttcgggttataggtaatgtcttttgtataaatgcatacttcatacataagaattttcctttctctgaatttgtcttatgctgctctacataggctaagtgacatcacctcctttcctggttcccatttatacactaactaaagaaaacggccatgtgaaacatttcacttagccgcctcttatcttaatcttatatatctcatttttgtcttacaaattttctatactgttttaaaactatcttagcttttgagaaacacactacaccgttaaatataaatcctttccaaaattaattagagccattattacctgcagccagaattaacggcttagtcataattcatccccaaaaagcagccatatatttaattatacatggctgctttttccccttacaacgcaattcctgattatcgaatttccataaaatagattttatatattctccttgttttttagtctttctataaaaacaaagcctaaagcagcaaaccatcatcaaaacaggaaaaataaataccgttttttgcctgttttcagcttcattttaagtctttttcagttttcacctgtaacatcctgtagtttattttgatttttcccagacaaaccacaacgctccatcattaccactgtctcaatcccggaagtccacggaaactgatccacagcaaccgctctcctgaccgcatatccgttcccaagaaacacctccagatcccgtaccagactggtaggcttgcaggatatatacaccagcctctccaccccatatctgataatcttctgcagagccccgggatgaatcccgtccctgggcggatccaggataataaaatccggtttttcctcaatctcatccagcaccttcagcacatcaccggcgatgaactcacagttattaagcccgttcagctgtgcgttctttttcgcggcctccacagcctcctccacgatttccacgccaatcaccttttccgccaccggcgccatgagctgcgcaatggttccggtaccgctgtaaagatcatacaccacacagccttcctttttcagttctccgatgtactccctggccgtgcggtagagcacctccgcgccatagctgtttgtctggaaaaaggagaataccgataccttaaacctcagccccagcagctcctcataaaaataatcctgcccataaagtacttccgtccggtcgctttgaaccacatcggctacggaatcgttttcaatatgcagaattcccgcaatttttccctccagcggcagtcccagaagcatgtcccggaatgcagccagatccctgttttcctgcgttgtagtaaccagtgcaatcaatatctccccggtatgggaagcctttctcaccagcagatgcctcagatacccctgatgtgtcagcctgtggaagaaggccgccttctccgcggtaaaatagtccagcgtccccttaagaatcctccggtagtcctcatccacaatcctgcagtccctcacagatacaatatcataaaaactccccctcttatgcattcccaatgccagggggccgtcctttacctcgtccccgaaggaaaattccatcttgttcctgtagcccagctgtctcgggcttgcttttatcggctcccaaacccatggctcctcctgcctgcaaagcacgctgtccaaaagctcctttacctgcttttccttcagcgccagctgcttttcataaggaagcgccagatatgtacagccgccgcagcttccgaaatgggggcagggcgcttccacctcatcgggcgcctgctccagcacctccagcacacgtccctctccttttcctttgcgtacctttgttatcatcacggaaagcttttgtccgggaagcacattttttaccgtgcagtactcagccgcagaagccatttttgttgtggaagttcccattgcagacgcttccgccgcaaaggtttccgccgcggacattcccggagccgttccttcctccctgtcttttaaaggcagcaattccacatttcctttattggggaacttcacgtcccgtacgattccttctctgacctgaccttttttcatatcgccctctcacttcttccattctgtataataaacttcataactgtcccattacatcacaattacataaacattaataaaacgcctaaaaaacgggatgcctcagcatcccgtctcctgtcgatactttacttattcttcacttgtttcttcatcattcccggcatcatctgccttggcagtatcttctgttgtatcggtgccttcttcatcctcatcttcaaaaaattcgtcgtcgaaatcatcatcaaaatcgtcgtcgaaatcttccagataatcaggagtaagataacggtacaccgcatatgcaattcctgctaccgccgcaatggctccgataattgcaagaatccagagaactgtattcccattgtctttcttttcttcttttttgccaaggagttcgtttactttcatcatttctaatacctcatccagctttcccatgcaaaccatcctttcttccctgctactagtatgcttaaatactgttcttatcataccactttttacattgctttactataaatttttcatgaaataaatatgaacttgtcgtatccatatatcagttcagtttactgaaccgatacgttacgatgcccgggaaaaaatataatccggccgtcagaacacaacaaaccggttctccaaaagcggcttccccttatatcttcttcagctttgcaaaagcggcatacatgatcttctggcccgctttatcaaaaagaacggtgacctgatagtccctcggtccgtccacaatgttgagcacggttccttctccatatttaatatggcgcaccctgtcaccaataccgtattccaaactggcctgtttggttcctgcccccttgctcagtcctgctactccggccaggcttccgatgccctgggcaataaagggcttgttttccgggtcggtccgtttgggctttaccacagctttcggccgccagtccgccgcctgggagggcgcgcccgcataattgccgccgtaaggggccgtctggaatctggcgcggctttccggcgtctccctgtattcctcaaaatccgtttttttcttgaatatctgaggcttgttatccagcaattccccggggacctcccggacaaaccggctgaccgggttgtactgcgtctcgccgcgcagcatgcgctgtttggcacaggtgatcgtcagatcctccttggccctggtgattcccacataagccaggcggcgttcctcttccactgccgaagggtcgtcggaggtgattgtcatgtagctggggaacacgccgtcctccagtccggccagatatacatgggggaactccagtcccttcgcggaatgcagggtcatgagaagcacccggttatcctccgcatccacgccgtcaatatcagccaccagcgccacctcttccaaaaactcgctcagggaggggtcgtcatggctgtcctcataagccaccaccttacttaccagctcgtcgatattctggatacgatcctccgcatcctcctcgtccgattcctgaagctccttcacatagcccgtagtttcaataatatcgttcatcagctcttgcaggctgtaatattccagcttgctgcggaaggactggatcatcattacaaagggcttcagctttgccgcactttttccgatgctcagaatctgatcggcttcccggagcgcatcatagaagctgagtcccctggcgtccgcatattcctgcacacgcaggatggtagttgcgccgattccccgcctgggaacgttgatgatgcgctttaccgccagatcgtcccgcccgttgtcaatggtcttaagatatgccagcatgtccttgatttcccggcgggaatagaaattaaccccgcccaccacatcgtagggaatgccttccataataaaacgttcttccagaatacgggattgtgcgttggtgcggtaaagaaccgcgcagtccctgaattccgctttcccatattttttcttctttccgatttcacctgcaatgaattcggcttcctcataggcggtgtcaaactggcggaaatgaatctggtcgccctctcccttttccgtccacagcgccttctccttacgctccacgttattgcggatcaccgcattggccgcatccaggatggtctgcgtggaacggtaattctgctccagcttgataacctccgcctcgggaaacaccttttcaaaatccaggatattgctgatattggccccgcggaacttgtagatggactgatcatcgtcacccaccacgcacaggttccggtacttgcccgccagcaggtgtatcagctcaaactgggccgtattcgtatcctggtactcatccaccatgatataacggaaacgctcctgataataatccaacacatccgggcaggtcttaaacagctccactgtctttacgatcaaatcgtcaaaatccagcgcattattcttatgcagaacctcctgatattccttataaacctgcgccgccctctgcttcgtgtaatcccccatggccttcagctcatattccaccggggagatcagactgtcctttgccgatgaaatgacggataacagcgtccgctccttcagcgtcttggtatctatctgcagacgtttgcagatatccttcataatatttttcgtatcgtccgtatcatagatggtgaaattattcccgtagcccagccgttctatgtatctgcgcagaatacggacacaggtggaatggaaggtggatacccagatgctctccgagccaaagcccacgatatcgtccactctgtcgcgcatttcccccgccgccttattggtaaaggtaatggccaggatattccaggggttcaccctcttttgttctatcagataagcaatgcggtgggtcagcacgcgggtcttcccgcttcccgcaccggcaagtatcagcaccgggccgtccgtgtggtagaccgcctcctgctgcctttcattcaaagtatcataaatgctcatattatttctccattctcgcctcttccgtaaatccatgctctctattatatcggaacatgcattcgatgtcgatagaaaaaaggggaattttttataaaaaaccagtctgccaaaccggttgggaaagccggaaaaagctgccgggaatcacctcccggcagcctgcccgccgcgcacggctttatatatgacgtccaactgtacttaataaaccagcgccagcacgccaaaattgcttgtggccaccgtcaccgtcctcggatccacatccagatccggcagcacctcaatggagccgtttgcaatgctgattacctgaaaattattccaggcctggaactgatccggcacgccgatggtcagcaccacaggagcgagcgtccggcttatgatgttagtcttcccgccggcattgctcgtcagctgcacatccagcatggatatcacgtttcttccgttcatggctgcagtgaggaacaccgcctgtctggcctgcggccctgtctttccttccgttacggaaaaataaaggcccgcaccgttctttatctgggcatccgtcagcccggcagccgttttcaccataccgtccggcgaaaggatgatgaccccttttaccgtgtccgcataaaaataggtaggcaccgtggaattcagcttaattccggtactcatctgcaccacattgggctttgtgggcgccggcgcattcccgctggccgaattgccgctggccgagcctgaggctccggccgtaatgggaatcaccactgtgagcagcaccgctgccgcaaaatacatcagccatttctttccttttttcatagcaacaccttaccctttcccgttgcacgcctccgggccagccggccggacgctcccctttttccataaatctttgtagctgttcaccatcctcactattgaaggccttttgctctttatcctcattttactctattctcccgctttatacaaccactgttccatgccagtcctatcgcaagaaaaaggaggggtgtgctcgtaatctgctgaaaactaaccatattatgaaccgtgtaggtaatgattgccagcgctcccgccgcccctgcagttccgcccttacgcaggaaacgcaccgcagcgctgaccaggaagcccgcataggcaatgagtcccagcagcccggtgtccatcagcaaggtcatccactcgttatggcagttggtcaggaccgcatccgcataaatctgcgtcagaagcggcctgcccccctgctccgcataaaggaaggccttcaggcagtccggccccacgccgaacaacttcctggcaatgtcctgttcccgccatatttccaggcactccttccagataccgccccgtccgttcccccactcctcattgaaaataaaaatggacggcaggctttccttcattccttcccctcccagcgtaccggccgccagaagtcccgcacagatcaccgctgctgccgccggcagcagcacgcccattttccgcataagggaaagccgcctcccctgctgtacggcatctgcagacttgtcgttccccgtcctgcctttttttactccgctgcgctccatcccgccttttttcattccagagtgctccccagcgcgctccgtcacgccgcatttcttccaccagagccgccccgcaaacgcagccgccgtaaccgcccccgcgccatacaaaacgctccccgttatccagctgcccgcttccacagttccccgaaacacccgcagtcccagcagccccacgaaaacagcgcccgaagccgtcagaaacacatcctggaatgcggacattcccgctccgtccctgcaggaaatcaggaacagcacccacagcgccgtccctatgatcagaaaaccgctgtcactcccctgcacagccgtacacagaaaagccgccgccgtgaaagcccccgctcccgcctgcagccattttctgcctttccgcccttccctgcattttccgccgttctgcgcttccctgcggcttccccagaacaccgcggtccccacaggcagcagcaccgacagatacccgcacagccagttcacattcccaatagtggaaagcgtcgtatccgaccttccccggaaatccaccggccaaaaaccgaaccggttcagcgccgccaacaggcaaatcccgccggaaactcccagaatcaccccaaccgcttctttttccgccttccagacatacgcataataaaaataaagcgccagaaagctcatctgggaaaaaagccccatataccagccctccgccccaaacaatccctcttttttataggaagaaagacaaaaagaaagtatcaccgcagcgccataagccagaagaaaaagctccggcagccaggttccggccttatccttaatccaaatgcccggcagcgtcccattcccgcctttttccctgccccagagcctccgtcgtccccctttacagccgcccgccgcttttgccgcagcaaaaatcaccatcaagggcagtgccatgaagcccacattccggtaaagctggaattttgccgtcccaagcccataatatccgtcatgcatatacagcggcaccatacaggccgcaaccagaagatataccgttgcggcggcctgcatggctttttcacacatcccgcccgcttttttccgccaatctgcaaatcctgccattttcacgcccagcttcctttttccgtaaccgcccagtcccctcgcagcttttgccccaatccacaagtgacttttttccgctcttttctatcattatccccaatccctccttagctgtcaagccggcgctttcccccaaaaaagcggctgtacagccataccagccaaaaaagaagcaccttccgcgctttttttcatacaatataccatcaaacctatggagggatttatgaaaaaaagaattctcgcatttactttggttcttgccatggctgtctttacctttgcaggctgtggtaagaagcaggaaaccgccaaggatacgccggataaagcaatgacggaggttacgctgaatgaggtagcccattccattttttatgcgccgatgtacgtggccatcgaagaaggctattttgcccaggagggcatcgacctcacgctggttaccggctttggggccgataaaaccatgaccgctgtacttacagacgaagccgatatcggctttatgggctctgaagcctccatttatacttatctgggcggcacggaggactatgtggtaaacttcgcacagctgacccagcgcgcgggcaactttctggtagccagggagccgattgacaacttctcctgggatatggtgaaaaacaccaccattctcggcggcagggccggcggccgacctaaccacgatgtaacatttgagcacattagggaaatttacgaatggacaagccgaaaatccctggaattgccggttttcaagtatgaggaaaagattatatctgcttcatagcattgattgaatatatagagtttgcttaaagaggacaggcccgccctgtcctttttactatcctcaaaggaaggaggcgaaaattgtcgcaaggaaataaccccttaaccgggcctgaccgtaatggttgggccttttttcatgtcacgaaaaggaggtaatgcacacatggctgatgataagcctaaaatttcacaggaacagtcctctcccaccgacccgcctgtcagtcaggaggtcaaggacactgctccggctgtagctcaaccgggtgaggaaagggacaaggcggctgatacaaaatcgtttgaaacgaaggaaacagaatccgctggttctaaaaagctggacgatattgtaaagcaagtcaaagatgcccagcagaagcagaccgaggccagtcttgccgctcccgacaaaaaacagtccgcttctataactaagttatctgatttgccaaagaccggacagaagaaagttgagaaaccggagcccacacaaaagactgccgctgcgaaaaaagagacaaagaaaaagcccgcacagacagcgaaaccgggaaagcccaaaagtacggcttcagcttctaaaggagctcccggagccagtgtcccggcacaatcagcacccacgcccccggagccaccaaaggaggcaccacgccggggagaggaacagattgtctatctgaagctgaatgagctccacgccttcaaaaaccaccccttcggcgtgcgtgacgatgaagaaatgcgggccatggtttccagcgtcaaggacaagggtgtgacccagcccgctatcgtccggcccttggagggcggcggctatgagattgtatccggccaccgccgtcagaaggccagcgaactggcaggctacacggacatgccctgtatcgtccgcaacctgaccgatgatgaagccatcacgcagatggtggaggacaacttaaaccagcgtgaggaaatcctccccagtgaaaaggcgaaggccctgaaaatgcagttggaggccatcaaacatcagggagcccggacttcgggccatgttgacccgaaggaggccgggaaacgctccaatgagattgtggcagagcgcaacaagatggcggtcaaacaggttcagcggtttatccggctcaatgagctggttcccgacttaatgaagctggtggacgataagaaaatcggcttcacaactgccgtggagctctcctatatcaataagaaaaaccagaactatatcgctgtctccattgacagccagcaggcttcccccacacaggcacaggccaaacgcatgagggagcttgacgaaaagaaactgctcaacggtgacgtgattgacggaatcatgatggaggataagaaggaggtagacaaagtgattttaacaggtgcagagcttgggaaatattttggcgcggaggccaccccgagggaaatgaaagaccagatcatcaaactgctggacgattggaagggacagcagaaggaacaggtcaagccggagaaaaaggctgacaaggagaaataagcggggcttcgggccagtgtgacccgagactaagaccgtggggcgcagccccacaccccgaagctcgaaggatatataattccccgtcgccgtttgttggatagcatagccgggaaaatctgtcaagggcctgccgccgtaggcggtgcttcgcacccttgacagatttctcccggttatgctttaaggcggtcaagcgacggggatataaattcctttgagccgttccccttcccacgggaaggggcggaggggttgggctctatcctgctactactcttttatagaagaaacggaggtaaaaacagtgaaacgacctttagcttatattactgcggcatggaacggggagccggatattgacgccgcccttgccgtccaatactgccggattacttacgaagcgggattctcaccgatctgcccgctgttgtatctgccgctgtttatcaatgacgctatccccgaggaacataaggacgggattgacatgcgccgggatatgctccggcgggcccgggtgcttgttgtctgcggcggtgctgtggacgaagatgtaaaaaatgatattgccgtggcccagcggctgaacatcacggcaaccaccctggacgggattgtgacggtcaaccagcagggccggaacgcagatgatgtttgaagcctatctgacaaatgtggccttatatgctaccagaggcgttgaggtcggggagtatttaaaattcccagccaccacggaggaaatacaggcgcttctttcccggatagaaatagacgggaagaaatattcagaaatcttcatcacgaactttgaaagtgacgtgctggggctgtccgactatcttgatgaatatgaggatattgacgagctgaaccatctggcgcatgttctggaggaagtacgggataagggcgaactggcaaagtatgaagccgcccttgttttgggaaaacatacggcaagcgtaaaagatttaatcaatctcgctcaaaatcttgatatttacaactttcagccgggtatagaaacttgggaggctttaggctgttattatgcggacgagctcatggcaatcaatatcccttccgatatacgggcctattttgactatgaggcatacggacgcgatatcgccatcaacgaaggcggctgttttgcgccgggtggttatgtgtccgccgctccccttgtatttaccgagtattatcacggaataggggatatccccgcagaacaccgtgtatttgcctatcccaacgaaacgccacattccattctggaaaccttgaaacagttaaaagaagccccgcttgctccgaaaaaggaaaagacggggccttcccatgaggaacggtaagacttcgggccagcatggcccgaggccgcaaaggaggtgcaggtaacattaactactatccaatcaacgagacagcggcccgccgtgccaaagagatgaacagcttttatgattatcaggaagggagtgcaaccgccgaataccatagcctcgtagataaggccgccgctgtggcagagaaacagaaaacaagggttgaccccatgtttcatgaaaaaatcgaccatctgcttgatacctatgcccgcaagctggcagaaaacatgaaccagcagtttgcgattgacgcgcgggttccgtccgtcatgatagccgggcctgccaacttccccatcaggcagaaggaaaaccagaaccgggcccgcgacagcaacatggaggaatggcggcatattcagggcctccttgataaaatccgcagtaccggcatgggcggaatcagcgcagatgacccggaggccatcacgaagctgaaagagaaactggaaggactggaacgctcccaactgattatgaaggaagtcaacatttattaccgcaaacacgggacacttgacggctgtgtgcttctctcccctgaccagatagaaaagctaaaggcggatatggcccggtacagttggctgagaaagccctttgaccttacgaataccagcgcggaaatccgcagggtaaaggaacgaatcgaagatttaagcaaacgggccgaaacggaattttccggctgggagtttcagggcggccatgtggatatgaaccggcaggacaaccgcctgcaaatcttctttgacgggaaaccggacgccgatacccggacggaactcaaagggaacggattccggtgggcccccagcgtgggcgcatggcagcgacagcttaccgataacgcaatctgggccgccgaccgtctggattgtatccagccgctttccggtgaacgtccttcccagcttcaaaagaaggcgcaggaaaagccgtctatcctgaaaaccatgcaggaatatccaaaggagccgggacaggaaaaaccgcttacgcctaagaaggaggccgaacggtaggcttcgggccatgctggcccgaggttatgaagggagtgattgattatcagtaagaccagacaaaagcggctggcggagcagaaggaagtaaaggaactgctggccgtgctgaaggaaaacaatttttccagcgcaaaggatctcatggccgccatcggccatgtgtcagacttggaggaacagctttccagtgcggttcaggagcttaccgccatgcggcaggaattgcaggaaatgaagcaatcgccgttaaaggccgccctgcaaaggtcggttcagaccttggaggcgaaagtttcccagttgagggtgcagattgacgcgctgaaagaaatcatcatagagggctgtaaacaggcccttgccgattttaagcagcgaggaacggcggccttagacggcgtggcccgcttcttccatctgcgggaaggtctggaaggggtaaaggaaaccattcaggcggggattgccacagacgaaaaggcccttgcgaaaatcgaagccgtttcagccgaataccacgaggcgggcaggcatttgaaaaatgtaggccgggccctgatggggaaggaggccgtatcaaaggcaaaaggcccgggcaagctggcaaaaacagttgcggcaccttaccgggctgaacgctccagcctgctctccatgcagaaaagcgtggaaaaagccctcgcccggatagaacggctggaacaggcggcagaaaaaaagccgtccatcttagacaccatgcggacgcagaatgaaaagatacgggcggaaccggcaaaagaggccccgccctccaaatatgccgagcggtagacctcgggccacattggcccgagattttccgtctcccgtaaagataagaggccccccggagtttatgggagcctgacaggaaggaggtattatgcaggacgaagtaaaccaaaaaacggttgccctctcaatccgggcaacaaagctcacaggccgggtgctggcctccgcaatatggaagattttagaggaagggaaaaagcgtcaccagaaagcgctgaccccgcaaggccgccaaagcgtgaaaaagctgatgaaccattacggggccaaaaactccatgcccctcgtgggagcgccccggcagtttgaccgcatagcaaaggaatttcatgtagactatgcgttccataaggtcagccccggccactacctgctgtttttcaaagcgggacaggcggacgccatgacggcggcgttccagaaatacagtgacaaggtgctgaataaggggaaagacaaggcttctatcctcggccagctacggaacctttcagagcatatcaagtcccggccgaaggagcgccagaaaaccagagaggcggtgaaggaagaacggtgagtgacaaaatccgaaaatatgtgcttcccaacctcccctacctctttgtattctggttcttctcaaaggtggggacggcttaccgcatggccgccggagccgatttcggcacgaagctcgtaggcatgatgaaaactttccctacggcctttgaaaactaccttccgggccttggcgggctagaccttctggtggggcttaccggggccgtgggaatgtacctgcttgtgcagtccaaaatcaggaagggaaaaaagttccgccgtgaggaagaatatggctcggcccgctggggtacggcaaaggatatcaagccctttgtagacccggtatttaaaaacaacgtcattctcacgggtacggagttcctgacactgaacacccggcccaaaatcccggccaacgcccggaacctaaacgcctgtgtgatcggctcgtccggctccggaaaaacaagattctggctgaccccgcagctccttcaggcccattcgtcctatgtggtcgtagatccaaaaggcggcaccctcgaacaatgcgggcgtttcctgcaacgacagggctaccggctccgggtgttcaacactatcgactttaccaaatccatgcattacaatccactggcctacgcgcgacacgaggtcgcgtaattaaactgttcggcgctgaccgaacctgttattccattagcagtagcctatcgtcaccgaagcggctggcaacggtcgtgaggcagcatggcgagaaaaggtagccctcccgaaagggtcaagccgaaaccgcgaggcagaggcgaaaagctggaagcaacgtccggctggggagcttggcttgtgtagtatggtgaatgtgagtaaatcgctgttaaacgtcgttagcgggaaccaggctaaagttgctgataagcctgaaccaaaaaggtgtgcagtcggatgttctcctgtaagctgggaacacatggacaaacaagactgccggcggataggcggcacctaacctacacggttgattacgtgaaacgtggtaagcccgcgctctctccgtatattcggaaagctgaccgcaaggaaagccgatagaaacgcgggtaaggaacgctggaaaaagcgaatgccggccttgtaatgaggacggatagggactgaaacagtatcccacgtgaaagcgggctgacttccagcaggtctatctttacgagagaatttacagaacttttgagaggaggaatcgcaaatgaacaggaaactgtgtgcgcctgctgacaaggcacaaagctgggaatccattgattggaagaaagcggaggcctatgttaaaaagctgcaaatgcgtatcgtaaaggctcaaaaagacggtcattacaacaaggtgaaatctctgcaatggctgttgacgcactccttctatgccaaagcgttggccgtgaagcgtgtgacaagcaacaaaggtaaaaataccgctggtgtagaccatgaattatggaaaacgccaaaaggcaaattcgaggcgattgataaactcaaacgccggggctataagcctcaacctctcagacgggtgtatatcccgaagaaaaacgggaaaatgcgtcccctgagtattccaacgatgacagaccgtgccatgcagacgttatataagtctgcattggaaccattggcagaaactctagcagacccgaactcctacggttttagaattggaagaagcacacacgatgccatcgggcaatgctttaacgatttgtgcagagccggttcccctcaatggattttggagggagatattaaagggtgctttgaccatatcagccatagctggttaatggaaaatgtcccaatggacaaggaaatgctcgaaaagtggctgaaatgtggctttgtggagaccaaaaagctctttccaacagaggaaggaaccccacagggcggcacaatatcgccagtcttgatgaacatgaccctagacggtctggagcggattctaaaagaaagattcccaatgagacggacggtggcaggtaaaactgtttacgaccagattaacttcgtgcgatatgccgacgactttatcgttaccgggaaaagcccggaaactttgcgcaacgaagtcatgccgctcatcgaggactttctggcggagcgcggcctgcaactctccgaggaaaaaacggtaatcacgcatatcagcgatggttttgattttcttgggcagaacattcgaaaatacaacgggaaattgctcatcaagccgtcaaagaatgcgataaaatccttcctcaaaaaagtgcggactatcgttagggagaacaaaacagccacacaggacttgctcatttgcaagttgaatcctgtcattcgtggttgggtcaactaccaccgctatgttgtttctgcggatatttttggattggttgaccacaggattttcgagtgcctatggaggtgggcttgccgcagacacaaacgaaaaggcaagagatggattgctaataaatactggcaccacattgacaaccggacgtggacgtttgcaacagagcctgctttccgcggtaaggatttcgatgaaaaatacctcaagctggaatacgcggcaaacactaaaatcattcgattcaggaaaatcgccgcagaagccaatccgttcgatgaaaagtggacgggatattatgaggaacgtgacggagaaagaatgctgaacagtaccaaaggacgggaaaaactcgttaaaatctggaacaaccagaaacggtgctgccctgtatgtggagaaagaattacatccgaaacaggattcaagaggcattttatcaccgaaaacaacagaaaatggcccgctattatggtacatccctggtgtcatcgaaatctgcatgagacagactacttgatttgagccgggtttcgttttacacgaggccttacgataggcttgagccgtatgacgggaaactgtcacgtacggttcttaggggaggggttggcagtaatgccagtctcttacccgacatcaagacggaaagtgacgtgctgaaattcgtcaacgccctgatcgccaataccaaaggggcgcgcccagatagggcgtagtaagaagtagaatcaggcactacccactcagataacagtggaaacgacccgcctaaccgataggcgaaagctgatgcgggaccatagcatggcgggaaagcgataagttgctctatacacaagagcacgactgaattgctacgttaagcggatatgaggatagaactactgaatgttgaatgcgagtttcaagtccccgttgtgttcgggcggaggaatgtgtatgtaaccaccgtagatacggcggcatcaacctctgacatgaataacattgcgtttcgcctttgcgcgatgggttatcaatccattcatgtgacaagccagagaactggaaataacgaaacgaaagcgtatccgacaatccgcatttgcctacttattacgctaactggggattgcctaagtcggaatgctcaaacgagctatgcgaaatgccccctgtgggtgataaatcccaagccctcgaaaggcaaggaagatgacgctgaatatccgatacggcaacggagttctcatagtagtcctgtgggaagtaacgactctcacggaatatatcctgtattccagacgaaggagaacagttattgcattccaaaattgaaatttgattagggaggaaagcctcaaatgcaaccaacaattgagattttggatagaatcagaaaaaattcaagagacaacaaagaggaaatcttcacaagactctaccgctatctattaagacccgacctgtattatcttgcgtacaaaaacctctacgccaacaaaggcgcaggaacgaaaggcgtgaatgacgacacggctgacggattcagcaaggaaaaagttgaccggatcatccaatctctggctgacggaacctatatgccgaaccctgctcgccgcgagtacatccagaaaaagcagaacagcacgaaaaagcgtcccctggggattcctacctttacggacaagctggtgcaggaagtattgagaatgatattggaatcggtctacgagccaattttttcaaacaactctcacggctttcgtcccaacaggagctgccacactgcgctgaaatccttgaaaagagaattttcaggtgtgtcgtggtttattgagggcgatattaagggctgttttgacaacatcgaccaccaagttttagcaaacgtcataaacgccaagattaaagacgctcggctgattcagctcatttggaaattcctgaaagccggttatatggaggactggcaataccatgctacctactccggctgtccgcagggcggcatcgtttcgcccatactcgcaaatatctacctgaatgagctggacaagttcgtggaaaagaccgccaaggagttctataaaagcagggacagacaccataccccggaatacgataaggtcacatggcagataaaaaaggctcaaaaacagctgaaaaccgcaatgggtcaggaaaaaacagctttgttgcagaaaatcgctcaattaaaagcagtcatgcataaaacgccctgtatgtccaaaacggataaagtcatcaaatacatccgttatgccgatgacttcattcttggcgtgaagggcgataaagcggactgtgagcgtatcaagagacagctgtccgatttcattagccaaaccctgaaaatggaactttcagagcaaaaaacactcattacacacagcaatcagtatgcaagatttttgggttatgacatccgcgtgagaagagaccagaaactaaagccgcacggaaaccacgtttcccgcacgctcaacgggtctgttgagctttgcattccattggcagacaaaatcatgcctttcctgtttgggaagtcggtcattcggcagctacgcgacggaacaatagagcctatcgcaagaaaatatatctttcggtgtacggatttggagattgtatcaacgtacaactctgagttgcgcggtatttgcaactattacagcatagccagcaatttcaacaagcttcaatattttgaatatttgatggaatacagctgcctgaaaactctggctggaaagcatgaaagtaccagcaggaaaatgatgagcaaataccgtgacggaaacggcggctggggtgtgccctaccaaacgaaagcaggcataaagcgccgcagtttcgcaaggtttatggattgcaaaaatacagacctctggacagataaaatcataaactttgcgattgcgcatgttggctccagaacctcatttgacgacagactgtccgcccgcgtgtgtgagctgtgcggaaagaccaatgtaccgctggaaatacaccatgtaaacaaagtgaagaacctcaaaggaaaacaactgtgggagcttgcgatgatagcgaaaaagcgtaaaacacttgcggtgtgcaaggactgtcatcacaagattcatcacccttgaacgacgctgatttgaagcaatgatggcgagccggatacatcgagaggtgtacgtccggttctgggaggggtttgggcaaacctacggcagtaatgccgcaaggcggctcattcctactctacgacggcaaagacggggacgagttctggacaaaagcggaaacccttctttactgtgcgttgattgcctatatcgtctttgaggggccggaggaagaacggaacatgaatacccttgtggaaatgattaacagcatggaagtccgggaagatgatgagagcttcaaaaatgccgttgactatatgtttgacgggttggaacggaggaaccccaaccactttgccgtgaggcagtataaaaagtataaattagccagcggcaagaccgcaaaaagtatattgattagctgtggagcacgtctcgcgcccttcgatattggggagctccgggaaattatgacctatgacgagctggggcttgatatgctgggagatgaaaaaacagccctgtttttcctgatatccgacacaaataccacctacaacttcctcgttgcccttgccttctccactatgttcaacatgctctgtgagcgggccgacaacaagtacggcgggaggctcccccatcatgtgcgggtgctgtgggacgaggcagccaacacgggacaggtgccgggactggaaaaaatcgtggccgtcattcgttcccgcgaaatcagcctgacgctgttctatcaggccatgagccagtgcaaggcgctctataaggacaacgccgagacaatcatggggaatatggattccatcgtcttcctcggaggccgggaaagctccacaatcaaggaaatttctgaaaattggctgggcaaggccaccatctccatgcagacagaaagccgcacccggggacagtccgaaagctacgggcagaatatgcaacgtctgggccgggagcttctcaccacaagcgaaatcaccaccatgcccggaaatatgtgtatctgccagctccggggcctcccgcctttttacagcccgaagtatgacttgaaaaagcaccccagctataatcagacagccgagtacgacaaaaagaaaaacgccttccgctcggaaaccctgttccgccaccggccattgagactaaaaccggaggacgaatacacggtctacgagatagaggaaacagacgcagaggaagaagctgacattctcaactttgacgacatggacagtgacgactttgcgtgacctcgggccacattggcccgaagcgccgccgttatgggcggctattttgttacccgaaaaccgattcaatctaagaaaatggaggaaaccacatggaatttttcaactctgctatcgacatattaaaggttctcgttatcgccctgggggccgggcttgcggtgtggggagtcatcaacctgttagaaggatacggctcggacaacccggcggcaaaatcacagggaattaaacagttcatggctaattaaagggaacaaaaagaaaggaaaagcacaatccagacggtatcagcgacaggctacaagattaaattgtgatttcacaagattggtgctataataagagaaaagttcctgccggggcaaccgccccggtggtatggatagaaaggcaggaaaacaatatgcacatcagctataaaccactctggcacacactgttagagcgtgatatgaggaaagaggatttaaggcttgccgctggtatgacaacgaatatgattgccaacatgagcaaagagggaaagcacatcagtatggacacattagcccgtatctgcgaaacgctgaattgtgagattaccgatgtgattgagttagtaccagacgagcctgcttccacaggaggtaaggaacatgagcgaattgaaaccaagaataacagaaaacggaattgattatatcctggttggggattattacatcccggatttgaaactgccggaggaacaccgccccatcggaaagtatggacggttgcaccgggaatatttaagagaagtccacccagccagattgaacacattgaccctgaccggggagttatggacataccttgcagacctgaatgaacaggcacagaatcggttagataccatcatggagcagatgaaagctgccgagggcgtgaccgaggaattaaagcgtacctgtcaaatggaatgggtgcagcattgcaataacattcacaaccgggcagaagaaattgttttgcatgagatgatttattcataacggtatgatagaatgattatgacaaatcgggattggtaggtgatagtatgaaaaagaaaacaaagattattattggaattttggttgtttttgcaattttagtggcaggaattagttatagagaatatataaaggcacacacatttacactctctggcaatgaacagatacaatcaatcacaggaactgtaaaagtaagtagtccgaaagatacagaagtgatttttattgatgtaaaaactggggtaaattatgctattccttatattacctctggagcaagtgaaacgattaagcttgaaaagggaaaatggtatagtgttgaaacaggcgaaggacttacaatgagtttggtgaatgttcgtatagaatagatagggcgtatatttatttttttgtggggcgtaggatcaaaagtcaatagaaaaagatatgagaaagcataaataaaattccagcttgtcattctgaaaatttaactgaataaccacagcacaaaccgctgctacatggaagctaacaaaccatgcaacagcggtttttctttaccgttttttcctctggctgattggcgttcccattttctttgattttttgagaatccgaatcagccagcgaaattcttcgtctgacagatttttatagttgataccgagctgtttacagtaaaggacaaccagcttttcatcccgactgcccttgaaattttcgactgcttccagattttctttcaattcatcggcaacggtggtctggggcgcactctcgctgtcctttttgtgggcttcccgaatatcccggataatgaggttgaggtcatcccgtaccatgtggctgaaatactcatcatcactgatatgtgcggcttgcagcaccttcaaatgcgggtcatcttcgccggggcgataccgttcaatgatttcatgccggacggtatcgacaagggcgttgaggttctgaatctgcatggtggcaatcccatccacataaatctcaatgtccgcaagaaacttgataaagtccttatgggtggcaagttcgcagagcagacggttgttaatccgaccgcttttcagaagtgccaccatttcatcgctcaaatgtagctcccttaatggcgtgttgatctccaccatgttctctgtccggcaaaagagataatcgagggacaccccataaaaatctgccagcaggataagattaccatggttgatttccttaaaatcatctttttcataacttccaagagctgattttgaaatacctgtttgctctgccagttcttccagttttaatcctttgtttaatcgtaaatcttttagccgttcctgtattgtagtagctccgttcattgaagcagctccccctttttgacaacatatataaccgttgaattgattataccatatcaattccgcaatcgtggaaatttctgatttttaccccgaattcctactttgtggacatacggcacagggcacaaaaatgttctatgatacaggtagttcatcgatggattattccaatcgaatgaccagcctgtgtgggatatgcttccccggtgatgtagtgccatgacttttggcagggatatggaggaaccctgaccaaaacgagcataccaaagggagcgatacgccgctgtgagattcaggggaggaacgacaccggggagaactggcgaactgacaccgaaatgataccgaaacacgacaatctgatagggggatagtctaccctatcactgatacttcgggagattttaagcggctctatgaccgtaattttgccgaaaatcgccccgaaaccatacacaaaaacgggaggaagcgcaatatgccgagaatgagcaaaaagaggaagcatgagctttccttttacctcaatgaccgggggcgtgtcacttacaacgaattatgccggaaatgccagcatgggtgcaggcagagcttccgggcggttgtggttgactgcccccgttatttatccaaacgagcaaagaaaaaggaggaacacaccgaatgaattttgaatttatgacgatagacacaccattgccgccgtgtatgccatttcccatagcgttgacaggatttccagtcagcagcaccgcaaaggtcatgtactgccggatgctggacgctatgctatccaaagggcaggaggacgaaaacggaatcctgtttgtctgcttccctgtcacagccattgccgcagtcctgtcccgcagctccatgacggtcaagcgttctctgaatgaactggaaaccgctgggcttatcatgcgggtgcgtcagggtgtgggagaaccaaaccggatttatgtgctgataccgggaaaggaggacgctgcccttgcctgagacctcaaagctggaaaaactcaactgggagctggagaaaagcgaaaagaaactgcggaaagccatcaatgatgaaaaggcattgcagtaccagttaaagcagcttacccgaaaggaacgaacgcaccggctctgtacccgtggcggtatgctggaaagttttctgcaagagccggaacgcctgacagatgatgatgtcatgctgttgttgaaactcatttttcacaggcaggacacgcaggaactattgaaaaaactgctggaacgggagaagccggaaaccccttagtttactaagggcgcaattatacaccacccagaagttggtgcattgcgttctccgaaggctcctcgccggagggctgtgattttccgcagtcatggtctgctccaaatcaaacaggggacgctacgcttcccctgcgctggctgccgccagctacccttttgtggacttgccatctggggacaccttgcgctgcaagctgttcccagccgacaagtttcataaaatatgctatcttttcgataggcaataaagtataatgaagtcagcaataaatcaggaatttgaggtcaaggattaaacgggaggtttatatgaaaaaataccaatgtccttgctgcggatattttacctataatgttccggcaaataaagattgtgggtatatttgccccgtttgtttttgggagaatgacccgtttattgcttctgataacgaaccaagcgactctaatcatggaataacactaaaagaagcgaaattcaatttctcaaaatttggtgcttgtgaaaaagaaatgttatgttatgtccgatcaccaagagatgatgaaaaagaaatttcatagcgacaacttccaacttgtagaactgaaaaattgaaatttgatgggatggtgatattatgaaaaagataatggcagttatgctatcgttgcttgcttgtacggttctgcttgcagggtgcaacacttcctccgaaagcaatgaagaacagtccttaaaggtatattcatttagcggagaaaatgaatatatttctgtgtcgaatggtgtaattattttagatggcaaagatgaaatttgctatggtggtgatttgaaagtgatgtcagacgattttgctaatattaccacatactcaacgaccatttatatcaatggaagcgaaaaagaaactctgctttctaatggtgttgatgatcagacaggtgagacaatagatgtttctggaaatgttggacaaatttctggtgacattctcagagatagtgacgctgataagttgactgataatttgtggtttgaattgaaaacaaccaatttgaacggagaagaaagcacttatcgggtacagttagagacaactgaaatcacaaaggaagtcaaaaagtaaccccaaactcttacaactaaatacccgccgcccacaaagcggcacaccaagcaggaaatctgaaaaaggttgcctgctttttttctgcccaaaatgaggtggtaaaacgccaccccatccaccaattaccgaaaggagggacacgaaatgccctgtccacacaacgaaatcacgattgttcagcgcagccagcggcagtctgcggttgccgccgctgcttaccagagtggcgaaaaactgttctgtgaatatgaccagcaagtgaagcactacccggaaaagcgtggtatcgtccacaatgaaatcctgctcccacctaatgccccacaggaatatgcagaccgcaatactttgtggaacgccgctgaagcggtggaaaaacaatggaactcccagcttgcaaggcggtgggtgcttaccatccccagagagataccgcccgaccagtatgctgtccttgtccgggagttttgtgagcagcagtttgtttccaaaggcatgattgctgattttgccatccatgacccccatccgccgggacacaatccccacgcccatgtcctgctgactatgagggcaatggacgaacatgggaaatggcttcccaagagccgtaaggtttatgaccttgatgaaaacggggaacggataaagctgccatccggcaggtggaaaagccacaaggaggatacggttgactggaacgaccagaagtattgtgaaatctggcggcatgagtgggaagttatccagaaccgctatctggaagccaatgaccgcccggagcgtgtggacttgcgttcctatgccagacaggggcttgatattatccccactgtccatgagggggctgctgtccggcagatggaaaagcgtggtatccagacgaatatcggcaacctgaaccgggaaatcagagccgccaacagtctgatgaagtccatccggcagcttatccaaaacctcaaaggctggattaccgagctgggagaaaaacggaaagagctgcttgcacaaaaggcggcggaggaagcaacacttcttcccaatctgctgatgaagtatatggcgatacgaaaggaagaacggaaggactggacaagggctggacagaaccggggaacttcacaggacttaaaggcagtcagcgaagccctgtcctatctccggcaaaaggggctttccactgtggaggacttagaagcatttctggaatcctccgggaaatcagccgccgattaccgcaatcagatgaagccaaaggaagcccgcagcaaagtgattgacgggattcttgccagccggacagactgcaaggaatgtaagcctgtctatgagaagtaccagaagatatttttcaagaaaacaaaggagaaattcaaacaggaacacccggaggttgcccggtatgagaaagccgccgcctaccttgccaagcacccggacgataaggacagcacccaaaaggaactgcaacaggagcaggaaaaacttctcagcgaaatcgcagagctgaaagtaccgctgacagaggtgcaggaggatttgaagaagctgcgggacatccgctactgggtacggaaagccacccccggcacagaggaaagcaaagagccgcccaagaagcagcccatcaaggaagtcttgcaggataaggcagacgagaaaaaagcacaaagaactgccccggcacagataaaacacagacaacaggatatggagctttaacaggcatttgccattttcaatcagagaatgtcaggtgcttttctttttttcaaggagggatagatttgaatgtatttgaaactgtgaagcagtccgtcacaacaagacaggctgcggagcattatggaatccatgtaggtcggaacgggatggcttgctgcccgttccatcatgataaaaccccaagtatgaagctggatcggcgttaccactgcttcggctgcggtgcggatggggatgtgattgattttgccgccgccctgtatgggctgggaaagaaagaagccgccgtacagctggcacaggacttcgggctttcctatgaggactggaagccgccgggaaaggcgaaaaagcccaagccccggcagaaatccccggaggaacagtttcaggaagcaaagaaccgctgcttccgtattcttgccgattatctccacctacttcgagtgtggagaaaggaatatgccccgcactccccggaggaagcctttcatccccggtttgtggaagccttacagaagcaagcccaagtggaatatctgctggatgtgcttctgttcggggaaacagaggaaaaagcggctttgattacggactacggaaaggatgtgatgcagcttgaacagcgaatggcagagcttgcagccgcagacgcagcaagaactaaaaaacaccatgaacgccatgcagccaccccagaacattgaggaaatcaaggcggggctggaaactaccgagaaaggcggtgtccgtcagagcatacggaactgtctgaccgtattccagcgtgacccgctgctttccggggctatcgcatacaacatcctgactgaccgcaaggacatcataaagcccatcggctttcacagggaaagcaccgccctgaatgatacggatatgaagtatcttcttctctatctggaagaaacctacgggcttaccaatgagaaaaagattgataacgccatcgggattgtggcgaatgaaaacaagtaccatcccatccgggactatctcaatacccttgtgtgggacgggacagagcgaatccgtttctgcctgcggcactttctgggggctgacgcagacgattacacctatgaagcgttgaagctgttcctgatgggtgcaatctcacgagcctttcagccggggtgcaagtttgaaatcatgctctgtctggtcggcggtcagggggctggcaagtccaccttcttccgtctgctggcagtccgggacgagtggttctccgatgatttgcggaagctggacgatgacaatgtgtaccgcaagctgcaaggtcactggattattgaaatgtcggaaatgatggcaaccgccaatgccaagagcattgaggaaatcaagtcgtttttaagccgacagaaagaggtttataagataccctatgaaacccacccggcagaccgcccccgtcagtgcgtgtttggcggcacttccaatgcccttgattttcttccccttgaccgttccggcaaccgccgctttatccccgtcatggtgtacccggagcaagccgaggttcacattttggaggacgaagccgcttccagagcctatatcgagcagatgtgggcagaagcgatggagatttaccgaagcggcaggttcaagctggctttcagccctgccatgcagcggtatctcaaagaacaccagcgggattttatgccggaggacaccaaagccggaatgatacaggcgtatcttgataagtacaccgggagcatggtctgttccaagcagctctacaaggaagccttaaaccatgcctttgacgaaccgaagcaatgggaaatccgggaaatcaacgagataatgaaccagtgcattgaccgctggcggtacttcccgaatccaagaatgttttccgaatatggcagacaaaagggctgggagcgtgaaaccccggcaacggacttatgcaacccgtctgaaaaaacgatggacggttttgtggaggtcacagaacagatggagcttccattctgaaaatgacagcccgttgcaccccctgttgctatcccgttgccgagccggttgccggggaaaatcccttatttccgggcttttctcccttataacaaccaaaacaacagaaaaataaaagaaaagtataaatagtaaccatcgccagattgagattgtttgcaaggtcttttgaagcccgttgccggacttcgttgccgacaccctctgtctggctattttcatgcatggaggataactgcctatggcaaaaaacaaaactgagattcatgtgactactgtgtttgacggagaactggacgcaaccgatgtgttcgtcagactgatttcccagaaatacggaaagacaaatacaaaagaatatcttgctaaaaagaaagatataggctataatgaagatgaggttcaaaagagccagataccgtctggattgtgtgggtaaatggctatgatgaacgaaatggaatacagaacaatcggttcggcacttgccgggggctatcgtgcggcggtctattgcaggctgtcaaaggacgatgacctgcaaggcgaaagtgccagtatcgcaaaccagcgtgatatgctggaaaaatactgcgaaaagcagggatgggaggttgttgcagtctatcaggatgatggcttcacaggtcttaatatggagcgtcctgatttacagagaatgttgagagccattgagcgcaggcaaatcaaccttgtcatcacgaaagaccttagccgactggggcgtaactatctgcaaaccgggcatttgattgaggactttttcccaagaaacggtgtccgctatatcgccatgaatgacggcatcgacaccctgcgggataacaatgacattgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaagaaccatctgctcattgacgaggaaacagccccgattgtgcggctgattttcggatatgccctgaacggtcatggtccgaactatatccgcagacggctggaggaagaaaaaatcccctgccccacatggtggaaccgggaacgggggcttcgcaatacccgcaccaaatgggaaaagaaagacccggaaaacgggcggtatatgtgggacttctccgttatcaaagaccttttgatgaatcccgtctacaccggggcgattgcttcccagaaaaaggactaccgtttcaaaatcggcacgattggggaaaagaagccggaggactggattgtggtggagggacagcacgaaccgctgattgaccgcatgagctttgacattgtgcagaataagctgaaatcccgccagcgtccggggcagaccaatgaaatcagcctgtttgccggactgataaaatgcggcgagtgtgggaagtcgctgacggtacgctacacaaacgcaaaacatccccagcggatttattcctgcaagacctacaatgcctttggaaagaaccactgcacccagcaccggattgactatgacaccctttacagccatgtgctgcggaaaatccgggaatgtgccagagctgccctgatggacggggaagcggttgccgaccgcctgaccaatacctgtgaagcagagcagcgggaacagcgggaagcaatggaacgctcccttacaagggacgaggaacggattgaggttctggacaaaatggtcatgcggctttatgaggatatgattgcagggcgtatcagtgagcagaacttcaacaccatgctggaaaagacacagaccgagcagactgagcttaaagcaaaagtgtccgagggcagaaagcggctgtccgatgaagttcagcttgccaatgacgcaaagcagtgggtggaagccattcaggaatatgccaacatcacagagctggacgcagccacccttaaccgcttaatcaaagaaatcgttgtgcatgaacgcattgacgaagataaaacaagacacatttctatcgaaattcattttaatctcaaacccatcccggaggtggaacaggtcactgcctgacctgtcccgccgggacggttctcttaaaaaataccatatagattttttgtacgccgccgcccgccatcgagcagagttttacacctaattggggataaaacagctcatggccggaggcggtgttgtcctgattggcacacagcttatccccctcttatccggcctgttctaaagcgttcccatttaaaggagtgatatatggatactatcatcaatgcaatcgtggaatggctcaagggtgtgcttgtagatggtatcatgggaaatctggacggccttttcaacaacgtgaatgagcaggtcggagggattgcctcgcaggttgggacgaccccggcggattttaacgccggggtcttttccatgatacggcagatatcggaaacggtcgttctgccaatcgccgggattatcctcacgttcgtcatgacctatgagctcattcagatgctcatagaccggaacaacctccatgacatagacacatggatgttcttcaagtggatatttaaaaccttcgtggccgtgacgatcctgacgaacaccttcaatatcgtgctggctgtctttgacgtgagccagcatgtgatacaacagtcggcggggcttatccagagcggcacggaaatcacgccggacattatggacagcctgcgcacggacttggaggcgatggagctgggcccgctgttcgggctgttcctccagtcattcctcgtccagttcaccatgaccgccctgaatatcgtgatatttgtcattgtctatggccgcatgattgagatatacctgctgaccagccttgcccctatccccttctccaccgtggcgaaccgggaaaccgggcacatggggcagaactatttccggtcactgtgcgcggtcggctttcaggggctcctgattatggtatgcgtggcaatctacgccgtgctgattcagagtattgcaacggacggcgaccccatgggagccatctggcgctgtgtcggctatacggtgctcctgtgcttttctctctttaagaccgggagcctgtcaaaatccatcttcggcaccggttaaaccggcagaaggacttcgggccaccctggcccgaggcgggaaggaggacatatgccgagacgctacaagctgggggcggacgggcaggcccacccggcctactttggaaagctccccgaggaatttacaaaagaggataccctgcgtttcctcgcagacacggatatccagttatacaggcttctgtcggcggacactcatgccgcactccgggcagaaggctacgagtataaaaacgggggccttatccccatttcagaaaaggagacagttatgcaggaacagacaggcggcgcacccgccgctacacaggaacccatgaagctggacgtgagcgtgaggctcattgaccccgtaaaaaacctgattggctttgccagtgtgaaattcaacgactgttttgtggtggagaatttcaagatactgcaaggcgaaaaagggatttatgcaggtatgcccagccagccggacagaaacgggggctaccgtgacgtagcaaaacccatcacgaaggagttccgcagtcagcttaacgaagcggttgtggaagcctatacgacggagctcgaccatttgcaggcaagattagcagccgcacggggaggccaggaacggccctccatcaaggaacagctcaccgccggggcaaaacaggcggaacaggcgcaggcggagaaacccgcaaaggcaaaggccagccgcggacaggacagataacttcgggccatggtggcccgaagtgaaggaaggaggcgtatgcccatgacacacataaaacaagcctatgacgccgcctgctactacgatggaaagctgttgggccgctgtaccgtggctgacagtgaagcctattcccttctgatgaaggagtgcggcggcgaggccgtccgtgtcctgcgggaatatccctacctgtccccggagctgaaagccattctggaaaaagcggcgctcatgcaggccgaccgccagaggacaggcggcatgttccatgagccggaaagctccccgtggggcaaggttcagacctgcgacacgctctgccccggggtgttccttgtgagcacggccagccacggcgggacaatggtagcaaaggaagtggccgccgtcctgtctactgcggctaaaaaatgcggtttccagaggaacggttacatctgttttgaggaggacgcacaggaaagcgtggtactgcgggagctcttagataaaaagctgtggaaaatccctgaccgtatcaaggataaggaaaaatttgaggaaaacatcaaccagtccatcagacagtataaccccgactactggcgggcaaggcaggccggacgagaggccgccgtggaagggaaacggcccctgcccgcaaaggagacggccagatagcttcgggccaccatggcccgaagtgccaaaggaggtgaacagcccatggcatatgtacccgtaccaaaagacctaaacaaaatcaagacgaagctggccttaaacttgacgaagcgccagcttatctgtttctcccttgcggcggcggtggggattccgtcctacctgtccagccgtggaaccatcggaaacagcccggcccttttcctgatgattggcctcatgctcccgtttttctttttcgccatgtatgagcgtgacggcctgccacttgaaaaggtgctgaggaatatcctgcgcacccggttcctatatccgagggtgcggccctatcagacagaaaatttttatgctctattgagcggtttcaagaaggaggcgaagccgattgcagaaccagaaaaaaagaaaaagccccgcaggaaaaaagcctgaccggaaaggcggcctgtttcccggcggaaagcggaaggttcccgccaccgcccagcagacccttccctaccgggaaatgtaccgggacggcgtgtgccgggtggccgaccattattacacgaaaaccatagaatacgaggacatcaactaccagctcgcacaggccgaggatcaggccgccatttttgacgggtggagcgcctgcttaaattactttgacagcaccctccccttccagctctcattcatcaaccaccggagccgcccggaaagccgctacagcgtcaacatctccatgcaggaggacgaatataacggggtgcggcaggaatacgttgaaatgctggaaaaccagatagccaaaagcaacaacggaatcgtgcggacgaaactgttgaccttcggcgtgaacgtggacgatttatccacggcccgggcgaggctggaacgggtggaggccgatatcatgaacaattttaagaagctgggcgtaaaatcagccgccctctccgggctggaacgcctggaactgctccacggccagctccacccgggcgggaatgaccccttccgtttttcatgggatatgataccaaaaaccgggctttccacaaaggactttatcgcgcccaccagctttgacttccggttcagccgtctgttccgggtgggcaccacatggggagcctcctcctacttgcagattcttgcctcggagctttccgataaactgctggcggagctgttggagctggacgcggaaatgaccatcaccctccatgtgcagacagtcgatcaggccgccgccgtgaaagctatcaaggccaaagtctccgatatcgacaagatgaaggtggaggaacagaaaaaggcggtgcgctccggctacgacatggacattcgtgcgactcgttcctgaacaaagccttcgtggttgaaggacaaaatcaggcattaacaaaagaacgaaaatttcaaatgttaggagaactaacaatccgagaggtggaatgatggggtaacgccctgaaacgcccccttaatactccgactggcatttcaacagaaatgtgacttgtcagaagctcggtgaagtcggctgagagtagccgtatggattgctggataaataccagcctcacgaaagctgtccagaggtggacggtgctacctataggccggaggtctacaaaatacccaaggtcagaatgtttgaaatatgactgacgaaaaccgcgaatgtaagggtctataccatgacggcatagaaatgtgccggtagcgttaatcgctaatcagtgtggtggagtaaaaattgatgttatgaaacaccatagcacgttacaggcgtgttcaagctgacaggcttaaagcggagacctaaaggtatatgtaaagataggattgttggaacgaggaaaggcagtaggcttccaccattaggaagtaagcagacgaatcatataagctgctgtactactgctgaaaagcagaggtcgaaccgatgatgttttctgcgaaaaagaggaaaacggaggaatggcctcaagtcagtcaaacagacaacttagcacttagtcgcaattaggattgcgagtatgacaaaaagaagtcactcgccgtaaaggagagtgatgcctgatgccaaatgagaagaaaccaaaaacaaaatacgtggagtatctccgccatgctgaatactacgatatgcagagtacctttgatgagctgtatgccagaagtcaagccggagaaatctttgacggcctgatggatgtgatactttcgagagaaaatatcctattggcctatcggaacatcaaatccaataccgggagttttacaccggggacggataagctgaaaatttctgatattggtaaacttaccgctgacgaagtaacagcgagggtacgtagaatcgtaaagggaggtaaaaacggctacaccccaagaagcgtgagacgcaaagaaatccctaagccaaacgggagtaccagacctctgggaatcccttgtatatgggatagattggtacagcaatgtatcaagcaagtcatggagcctatctgcgaagccagatttagcaataacagctatggattccgtccgaatcggtcggttgaaaatgcgatagcggcaatctacaggcttatgcagaggtcaggactttactatgttgtggagtttgatattaagggcttctttgacaatgtagaccattcaaagctgataaaacagttatggtcacttaatattcgggataaagaattgctctatgtaatccgcaggattctcaaagcaccaatcctcatgccggatggccatatagaacacccagcaaagggaacgccgcagggcggcattatttcaccactgctggcaaatgtggttctgaatgaacttgaccattggatagaaagccagtggcagtgcaacccggtaacggaaaactactcctacagggaaaatgcgacgggctgtccgatacaaagccatgcgtatcgggcaatgcggaatacaaggttgaaagaaatgtatatcgtcagatatgcggatgattttcggattctttgcaggacgaaagaacaggcagaccggacgctgattgcggtaacgcattggctgaaagaacgcttacgtcttgatgtttcgccagagaaaacgagagttgttgacaccagacggagctattctgaatttctcggattcaaaatcagactgcacaaaaaggggaaaaagtatgtcgttcaatcgcacatgtgcgataaagcctatagaaaggtcaaggccaacctgacaaagcaggtcgggaacatcaaatttccaagaaaagaccgtggagaggccggagaagtacggctgtttaactcaatggttatgggaatccagaattattatcagttagccacagacatcagcattgattgcggtgatattggcagaactgttaatatagtccttaaaaacaggctgaaatcaggaaaaacgcaccgactaaaagaagaaggtcgagaccttacaaaaatggagctccaaagatatgggaaatcggaacagctaagatatatagcacaatccaaagaaccgatttatccgataagctatgttcaatgcacaaatccaatgaatttgcggcgaaaagtatgcgcctacacagcgacaggcagaagtgcaatccatgacgatttacggataaacacttccttactgttacagcttatgagagcgcctacataccgccgtagtgcagaatatgcggacaaccgtatttcactattctccgctcaatgggggaaatgtgcaataacgggaaaggaatttcagtgtgtttcagaaatccactgtcaccataaaacaccaaagggtaatggtggcagtgacaagtatgaaaatctggtattggtgcttgcaccagtacacgaactgatacacgcagtcaatgaggatactatttgttcttatctctccgctcttaaattggacgcttcacaacttatgaagctaaacagactgcgaattctggcaaatcggaaacctattgatttggagaacctaaatcttacgaataattctcataatggtatgactaaggagactaagaaaactgtttgattgatggaacgccggatgcggtgaaagtcgcatgtccggtgtgaagcgggggaaaagctggagataacttcaaaggcttacctatcgctattgcctcccgaccttgtgacctacagccaggacgctaagacccttctggaagatttgcagagccggaatgaaagaatgttcctcctgaccttccttgtggtcaacatggcgcccacccggcgggagctggacaacgacctgttcaccgtgtcaggaatcgtgcagaaatacaactgcgccctgaaacggctggacttccagcaggagcaggcgttcctttccagccttcccctcggccacaacgccattgagatacagaggggcctgactaccagcagcaccgccattttcgtccccttcataacgcaggagctccgcatggacggggaggcggtctattacggcctgaacgccctttcccacaacgtcatcatggcgaaccggaagaaactgaaaaaccccaacggcctgttccttggcgtacccggttccgggaaatcctttgccgcaaaacgggagcttgtgaacgtgttcctcgccacccgcgaccggattatcgtagtagaccccatgggcgaatattccccgctaatccggcggctgggcggtcaggtgattgagattgcgccggacagcccgcaccacatcaaccccatggacatagatttgagttttgacgaggaaaatcccatggccttaaaggccgactttatcctgtcgctgatggagctcattgttggcggcaaggacggcctacagcccattgaccggacggtgattgaccgctgtgtgcgcttcatgtaccgggagcatatccagcacccggaaaagaaacagatgccgacgttgcaggatttatacgaactgctctgcaaacagccggaggcggaggcttcccgtctggcaacctcccttgaaatctacgtgtccggttccttaaacgtattcaaccatgaaaccaacgtggacttgaaccgccgccttgtgtgcctcgatttaaagaagctgggggcgggactgcgcacgattgccatgctcatcatgcaggatttagtgaactcacaggtttccctgaacttcatgaacgggctttccacatggtgctactttgacgaatttcacgtactgctccgggacgccctgacggccagctactgcgttgccatctggaaaatgctgcggaagaaaggctgcgtcccgtcagctttgacccagaatgtgaaggtgcgcccagatagggcgttgtgcaaagcagtttaaggtactgccgcacacggcagtgtgcgaaacaatctgccttaccgactaaggagaaatcctttacgggaacagcgcatggcagaaaaaggaatagtcaccaaaggacttaggtgcgactgtttcctaatgttaagaagatatgaggataagattgggtttatcgaatgtaaggttccagttcctgttttttgcaggtgtgggaaaagtcctgtaacccatgtcataacgctgtcacgtcatctttcacggcgggacaactgctacacgttatgaaacaggcgtgagaacacgtcataacgaaccgaaagcatatccgacaatcttcattcacctaagcacaacgctaactggggattgcctaagtccggctcattcgccggatatggtaacggaggctccatagtagtccgagaggggtaatgacccttacatggcgaagggagccagttagtaacatctaaaatgtaagaatgaaagggaggagaaacctcaatgaaaccaacatctgaaattttagagcgtattgaaaggtgttccagcgaacacaaagacggcgtattcacaaggctatacagatatttactccgtgaagatatttactacgccgcctatcagaaactttatgcaaacaaaggcgcaacaacacagggtatcgacgacgataccgcagacggtttcagtgacttctatgtaaaagagttaatccagtcactaaaggacggaacctacaaggctaaccctgtaagacgtgggtatattccaaagaaaaacggaaaactccgtccgctgggtatcccgtctttccgtgacaagctcctgcaagaagttgtcagaatgattttggaagctatctatgaacctgtctttgacagtcactcccacggtttcagaccgggcaaaagctgtcataccgcactccgtcagatttcttctgacttcacaggcgtggtttggtttatcgagggtgatattcagggttgttttgataacatcaatcacgaaaaactgattgagattttgagcaggaaaatcaaagacagtcgctttctgaacatcattcgccagtttttgaaagctgggtatatcgagaattggaagtataacgccacttacagcggttctccgcagggtggtatctgttcaccgatacttgcaaatatctatctgaatgagctggacaagaagtttcgggaaatcgcagaacgctttgataaaccgaggtccgcatatcagacaccggaatatcatacggcaagcaaagaattaaaaaggctgtcctactggattgaccataccgataatgaagcggaaagacaagaactgattgaccagcataaagcgcagaagaaagctatgagaaatctgccctgcaaacccgccgacaataagaaatttacttttgtccgctatgcggacgactggctggcaggtgtgtgcggcacaaaagcggaatgtgaagaattaaaaaccgaaatcgctgaatttctaagcacagagttgaaattgaccttgagtgaagaaaagacgctgataacgcacagctccgaaaaagtccgtttcattggctatgatatttgcgtccgcagaaatcaggaggtcaaaggtcacagaatgaaaaacgggacgtggagaaaatcccgtaccctgcacatgaaagttgcccttactattccccatacggaaaagattgagaaatttatgtttgcaaagaaagtcattcgccaaaaggagaatggggagttccagccgatacacagagccggacttctcaaccttgcggattatgagattgtggagcagtacaatgccgaagcaagaggactatgcaactattacaatctggcctgtgactatcacacgctggactacttctgctatctcatggagtatagctgcttaaagacgattgccaacaagcataaaaccagtatccgcaaaatcatccgccagcacaaagacgggaaaacgtggtctgttccttatgaaaccaaagctgggacaaaacgtgtacgccctgttaaaatcgcagattgtaagcgtggcgaagcgagtgacatcatctatcagagaaagaaatttagctggaaaaccactatcagacaacggcttaatgccagagtttgtgaactatgtgggtgtaaagaagccgacttgtacgaggttcacgttatacggaacctaaacgagttggggaattctgattgggaaaccgtgatgaaaaagaagcggcggaaaacacttgttgtttgtagcaagtgccatgaaagaatacacaaacactaatcaatacgtcaattactaatggggagccggatacttcgagaggagtaagtccggttccgagggagggtgtaggaaacctgccgccaacggcggcaagacgcctttaccctaccctacgattttctggcaagcccggaaattgagaatatttttgagaactcggatttcctcgtcctgcttgcacaggcacagggcgaccggcagatcatcgcaaaacagctcggtatcagcccgcaccagctttcctatgtgacccacaccaattccggtgagggccttttgtttttcgggaacgtcacaatccccttcgtagaccacttcccgcagaatacggagctctatgcaatcatgacaacccgcccggaggataagaagaatgagccaaaacaggaatgacaccacttcgggccaacgtggcccgaagctcacggtacgggaaatccccaaagagcaggccatcggctttatccgccgctaccattattccaaaatcatgccccggctgaataagcactatctgggcttttacactggaaaccgacttgcgggcgtggtggcgctgggctggggaacccagccgctccaaagcatacggaagatgttcccccgccacaggctccaatccggcgactatctggaaatcgggaagatgtgttttctccctgaaatgaacgggaaccagtgttttgggagccgggtgctctcccagcttgtaaaatggctgaaaaataatacagactgcctgttcctctacacgctggcggacggcattatggggaaatgcggctatgtgtatcaggccgcgaacttccggtacatcgggagctttcccaccagcgtctaccgctgtacggccaccggggagaaaatccacccacggagcgcaaggctcttactggaagaaaacgccgcccttgacggggtggaaagacggttctggttgacccatggctactgtgaatacaaggggattgaaaaaatcaacggcctcatgttccgttatctctacccgctgaacaggcaggcaaaaaaaatcctgaacgcctacccggagtaccgggggctcccaaacccgaaggataaggatttgaaattcaccatgcgaaccgccccgggcgtatacgccccaatcccgccgccgttatttaaccgtgatgtatgccaattcaacacacagaaatgttgagctggctttttttgttccgggaaaggaggaatgacctatgggaaaggaaccaaagaaagtcaggccaaaacagccgccgccggataccttcacctcgggccaacatggcccgaagcaggaaaccagcccgccgccggattccgccccttccggccgcctgcgttttgaggaaggggacacgccgccgcaggacggggccacctcgggccagcatggcccgaagccctccgggaagttccggcaggatacggagcgggcccgcccctccgaccatatgcggcgggaggaaaatgcggacggagacggagggcaggaaccccatgacaaagaggccgggcctgaccgggccggtaagaaacgtactgatggtgagaaatatgccgatggggagaaacgggctgacggcaaggaacgctctgacggcaggaaaccggacaagacggagaaggcacaggaaaaagcggataaggccgggcggaaactggaatcggcccgggaaaagctggcctcacagaagccgcccaaacagccgggactggcaaagaaggctgtccggggtgtgcgggcggaggtatggttttacacccacaacaaaatacacgagattgagcatgagaacgtaggcgtggaaggagcccataaatccgagcttgtggcagaggcaggaacccgtaagctcgcccggtttgccagacgccgctaccgtgagcacccggcccgccgggtggcgaaatgggaacgaaaggagctggcggcacgggccaatctggattttcagaagatggcaaaggaacacccggagcttgccagcaacccgctctcccgcatggcacagaaatggaaactgaaacgccagtatgccagacaggcaagacaggccgcaaagcagggggcacgggcggcgaagaaaacagccgccacagccggaaccattacgaaacgggcggttcaggcggcggcccgccacccggtatttatcctgattatcgtggtactgttcctgctgttttatatcctgtcagcgttttcctcccttatccccatgctggggagcggccttgcaaacgccatatccggcacctcctacgcctccgctgacagcgaccttttagggacggacgaggactataccgctctggaaaatgacctgaaacagaagattgccaatatcgagcacacccacagcggctatgacgaataccgctacaacgtagatgaaatcggccacaacccctatgagcttgcctcctacctgtcggccaaataccacagctatacccggtcagggatacagggcgaacttggggaggtctttgaagcacagtacgagctgacgctgaccgaggaagtggaaatccgctaccgcacagaaaccagcacagacgcggacggcaacgagacgagcgaggaagtcccttatgaatactatatcctccatgtgaccttaaaaaaccgcactctccccgccgtggtgaatacccggcttaccatggagcagaaggagatttattccgtcatgcaggaattaaagggcaacaagccccacctgtgggaaggcatttacacgggaggcggcacagggacggaccccggctaccagatacccggggaggccctgtccgacccgtccttcgcggccctgattggggaggcggagaaatacttgggctatccctatgtatggggcggttccagcccgtccacctcctttgactgctccggcttcgtctgctgggtattttccaacagcggcgtccataacctgccccgcaccacggcgcagggcatttacaaccagtgcgcccgtgtctcccccgctgacgcaaagcccggcgatatcatcttttttactggcacctatgacagcggcgtgccagtctcccacgtaggaatttatgtaggcaacaatatgatgatccactgtgggaacccaattcaatacgccagtatcagcacgtcctactggacgcagcatttctacgcatttggccgtttatcaggaaattgaccgtcataaacagaaaggagattcgcatgaacagacttgaaaaaatcgagaaggatttggagaaagcccgggagaaggccgccgagtgccaggccaaagtccgggaactggaaaaacagaaacaggaggaggaaaacagccagatcgtgcaggcggtgcgctccatgaagctgacccctgccgagctcctggctttcctaaacaacccgaaggacacccctgccgcttcgggccagactggcccgaagtccgctgacggaaaagaaaaggaggacgaagcccatgaagaagcctaaccttcaccgattgtcggcgctggccgcctgcctgctgtgcggtacttattttacaatccccgcctacgcccagagcagtgaaccgcaggccgaaaccacatcggctgaaactatcccagttgaaaccgtgaccccggaggaaccggcggagcccaatcccttcaccccggacggaaccggaaccgtggtggataaggccaccgacaaggacgggaaggaattttacaccatcaccaccccggacgagaatatcttctttctggtgattgataaccagaagtccagcgaaaatgtctatttcctgaacgccgtcacggaaacagacctccttccccttgcggaaaaagacggtgaaggaacggctgtggagccggaaaccacacccgcaccgaaaacggaaacggaaacggaaacgcccacggaggaaccagaacagccggagccagcgcccaaagaggataaggcagacaacggcctgttctccctccttctggttgcggcggtagtcctgattggcggcggggccggatattacttcaaaatctataagcccaaacatcaggccccggacttggaggacgattattgcgagtatgaggaagaagccgaggaaccggaagaatccgaagaagatgataccccgccgtggaacgaagaagaaccggaagcaggcggggaggacaaggaggacaggaaatgaatttcacagacagcccttttgaacagatgatgaaggaggttccccgtccgggcaggggcagttccggtccctgcgccgggtgccgttatgctaaagagtgcaaaaaccagaaaggacgctgccggaagaagttccgcgccctgcttgtggagccgcaggcttcgggccaacgtggcccgaagtcctgatggcccgggagctgacccgtgacgagaggaagaaaatccgggggcttgtcacgggcatgtgcgccaactatgacagcgaaaccggcctgtgcctcccgctggactgcccctgctatatgctgaataaatggtggacaggcgcttactgccgctacttccgtcgctccgtcctgcccctcaatccggcattggaaaccaccttattggagaaagggcccgcccccgggctccgaccctgcacggtctgcggcaggctctttttgccaatggggcggcaagcctactgctccgaagcctgcaaggccgaggggaaccgcaaaaagagccgggaacgtatgcggaaaatgagaaggaaaacggagggcccctgttacgttttgccctccgggaaagcctgattttgcaggatttctaagaggcagaaccggggccgtgataatctgatacctctgtccccggttttgctgtttatttcgtaacatcatcagacttcgggccatgctggcccgaggtcggaaaggagaatctgcatggaagatttaaaagggtatcaaatccagaaggaggccgtctttgagaatggccggggcttcgcgctggcccataacccggaggcgcagtccccctttgtaatctggcatttcacggttatgccggaaggggaacgcaattattatggctatacagcctgccgtggtatcctgccgccggaaaaagaatttgagaggttcctgttcgcctacgactatgtttacaaggttccgcaactgccggagggcaaaaggccgaggggaacggattattaccggtattacacccgctatccccttgacgcgaatgccttcccaaaatcaaaggagctggggctgttggagattgccccttacgataaccggacgatggtggaaggcaattccatacggacgtggggagaactgatttatactaagccgctgccggaaaagctggtggctgattatgagctcaaaccctcccgcctgaatcctgacgtaagaaggaaaatggaggagcagacgcaggcgcttggcaaatgggaggacagccgccatttcggtgataagcggcggttgacatggttccatccggattttgggacgtatatcctgaaacagcccctttccccagaacagctttccgaacggattgaggccatggaggaattggaggcagagcggaaagaaaaacggtcaatcaccgcccagctccgcaaagagacgaatcaggaaaaggaaaacagggaaccgcccgcgaaaaagggcggccactcccacgaggacagataggaggacgaaccatgcacgaaaaagacaattatttaaaaaatgcagagctttccacagagcagaactgcaacatgattgacgggattcccaataatacgccgctccctccggctcccccggaaccggacagaaagccgctggataaagtaaaggagccaccctcccgcaaacggagccgggaacgtgaggacagatgaaaggccgcaggcgcgatatccaccttcatgtgatggtgacggcagaggaactggcaagaataagagaacgcatggacgaggccggtatcaccaacgccggggcctatgtgcgcaagatggccttaaacggctatatcctccatgttgacctctcccccgtaaaggagctggtttcccttcagcggcggtgcgccaacaatctcaatcaggtggccgtccatgccaacatgtacggcgtatacccggaggaaatcgcagggctccagcgtgattatgaaacgctgtgggggcaggtttccgatgtgctgaaagagctttccgagctggtggcaaagtaacagacggggcggcggccatggactgacagttatggcctgccgccctttctttttttgagcttcgggccaatatgtcccgaagatatagtcaaaatcacgtatatatgataaaatacaaatattatgtagaatcgtgttcgttaaaattgagaaccaaattatcagagattgtttgtataaatatcgtatgcaggaggatacaaaagtgaataatttaagaggctcggaatggcataagtgggatttacatattcatacagcttcatcatatgatagtccttatcggggagatgatgctgatgaattactttgtgctacattgcatgataacaatattagtgctgtagctattacagatcactttaaaattgatgctgatagaatttcccatttaaggtctttggctcccgatatcgtattttttccaggagtagaactaagaacagataagggcgcagacaatcttcacctaataattgtgttctctaatgaaatagatttatcaacattatcaatggattttgaagcaattatgttaaggactaatgcaaaatcaaatagttcaccagaaacaatctattggacatttgaagatatagtaagttttgcgaaatcacatgacggacttattacaattcatgcgggaaaaaagacaaatggtattgacaaggaaatttctaatgctcttccagtaaaagaggcaataaaggcagatattgcagaaaatattgatttctttgaaatcggtaagaaaacagatattaatgattattataaatgggtatttaaggaagtagaagaaaaacctttaattatgtgctcggattgccatgacccgagaaaatatacatctaaagagaacttatggattaaagctaatcttacatttgaaggtttaaagcaatgccgctatcaacctacggaacgcgtttatattggtagtattccaccagcattagatagagcgaacaaaaatggaaagtctaatatacaacgaatttctgtccataaaaatgagaatcctaaaaatgtagatatagattggtttgattttgaattgccactaaattcaggtcttgtagcaataatcggaaacaagggaagtggtaaaagtgcattatcagatataattggccatttatgtaaatgtaatactatggaaaatgcttcgtttttaaatgaaacccgttttcgtaaaccaccgaagaattttgcagaagattacattgctactatacagtggggagattctcacgttgaatctatatctttatcagaaagtaactacaatacaaccattgaagatgcccaatatctccctcaaaaatatattgaggaagtctgtaatgatataggtaatgaattccaacgagaaattgatcgagtgattttttcttacgtagaccgtactgagcgtggcacagcaaccaatttagaagaattagtttttaataagtcaaaagctatttctttgtccatgcaaaaattaaacattgaaattaatgatatcaatgataccttgattaaacttgaagagaagaaaactacccaatataggatacatataagtgacagcctaaaaaaattaaaagatactttagaacgacatgagaatactaaaccacaagaaataaaaaagcccgaacctaaggaaggtaaatcagattatcaagataaattaaaaactttaaatagttctattgagagtttagaaacaaaaattgaagagtatcgtaataatttaacgcaaataaacattgtaatagatgaagcaaaccaacttattgccaaactggatttattagaatctaatgtaaaagaaacagagttattattgaaagattttataaaaaagtattcattagatgttgacgaaagcggcattacgttggttacgcctaaggaaactatacaacagtatattcttaaattaagtaatgataagattgtatttcaaaaatcacttaatggttctgatacagaagatggtcttttagataaactcgaaaaagaaaaagaaaagaaaagttcgcttatatccacaacggatagcgaagaaaagcaatatcaaaaatatttatctgatcttgatgagtgggaaaaacagcgcaaattaattattggcaccaaaactacagaagatacattaacatattttcaaaatgaagccgactatattgaaaacgagttagatacaatttatgaaggcacaaaaagtagacgagatgaaaaaatcagagaattatatctacaaaaaagtaatcttgtttcagtgtatcacgaaatatatgcgccagtagaaattgaaattaaaaagctgttaggagaattagaagaaagcatagaatttgccgcagaaattcaactggagcaaagtgattttgctgaaaccgctttatccttaataaatcaaaaatatgccggcctttttaaaggaaaaagtgaagcatataataaaatgaatcagttgcttagaaggactgaatttgataacgtggatagtgttatagattttattcacgatgttctggttgtagtggatgaagatttagataattcaacaaaaaaagttcctgataaaaaagcattatataatttgttatgttgcttggattatatcggagtttcctttaaattaaaaatgggagaaagagatttggaggaattatctcctggcgaaaggggcattgtcttacttgtcttttatctggcattaagtcaaaataatattccaataataattgaccagccagaggataacttagataaccagtctgtttatagtaaattagttccttgtatatgtgaagctaagaaaaaacgacaagttattatagtttctcacaatccaaatatagcaatagcatgcgatgcagagcaaattgtatattgccatatggataaaaatacacatacaattacctatgaagctggtgctatagaaaattcaatagtaaaaggtcatgtcgttgatgttttggaaggtactatgcctgcatttaatttacgtcaaaggaaatatacacagaaataaacggatttttagggagagctacttatgctctctcttttctattcttcgggccacactggcccgaagtcccgggacaggattcgctaatcattcgcaacattcctgtcccggggccgccatggtaaaatataggtagaaagaataaaaggcgttataaatgagattactgctaaagctgtttgccgttcccgtcatgctggcgctgacaatccttgcggccatgttgatgttcctgtttgatatctgttcgtatctcctgacagtggcttctgtcataacagcacttttgggtatcgggcttttctttacacccactccgcacggcgggttcatcttcctgtttctggccttcctgctttccccttatggattgcaggcggttgccggacttctgattgaggcggtggacgggctgggcagttccctccgccagttcctcgtaagctgatactgcttcgggccacactggcccgaggccaatgacggcggctcgcaagggccgctgttctgtttgggaaggagggattcatctggctaccaccactcttttgaagcgtcacgccaatgagggagaaaccatagccgaggcaatccgtgactgtctcgactatgggaaaaatcctgaaaagacggagaacggaaaatacgtttcctcatacgagtgtgacccggctacggtggccgccgagttccttttggcaaaggccagctataaggctatcacaggccgggagcagaaaaaggaggacgatatcctgtgctatcagatacgccagtccttcctccccggggagattacgccaaaggaggcaaaccgtatcgggtatgagttggctatgcgctggacaaaaggccgccatgcctttatcgtcaccacccatacggacaagaaacacattcactgtcacatttattacaattcaacgaccctcgactgcacccggaaattccgtaatttctggggctcgtcattcgccctgcgcaggctctccgaccggttgtgcctggaaaatgggctgtccattgtggagaatccaaagccccggagcaaaggagattataagaactacggcgaatggctccaaaacagggagaggccgcttaactttcaggataaactgcggctggcaatcgacacggcactggcaaagcgccccggcgatctggcggccttcctctccctcatggaacaggccggctatgaaatcaagaaggtcagaggcggcggcctgtctttccggctggccggacaggggcaggaacggtttacccgtctgcgggcctccacgctgggggaagggtatgacttaaaagacatactggctgtcatagacgggagccgaaaacactccggccaaagcccccgcaaggtcaatctgctggtggatattcaggcaaagctggccgagggaaaaggggcgggatatgagcgctgggctaaagtattcaacttaaaacagatggccgccgcactcgcctatttgcaggataacggcctgacggaatacggggaattggagaaaaaggccgccgagacaacagactgttttcacgtcctctctgaccggataaagcagacggagaacgccatgaataccaaccgggaactgaaaacggccacggtacagtacgcccgcacacggcctgtctttgagaaatacaaagcggcaaaatacagccggaaattccttgcggagcatgaggcggacattgagctttaccgggcggcacaggccgacttgaagcgtctgcttgacggggcgaagctcccgaagatggacgtattaaaggaggaaggccggaaactggcggagcagaaacggaagctctatgcagagtatcagagagtacggcgggatatgcaggaagtcaacacggcgaaagcaaacattgattatctgctgggctacgccgggcaggacaaaaagaaagaacaggagcgatagagacggtgaaaataaggagcaaagcgacgctgccacttcgggccagtatggcccgaggttccgggtttggggcgggccccaacaagcgtcctccgtgccatctgtggccacggaggaattgcttgccatttagtgacaccccgaaaaatgacacaaaaaaacagaggctcttactcctgaacctccgtttcccttgcttttttcagcccttcggctgtggcctccatgacaacaagctccttctcattcatcgcattgagcataacatcaatgtgcttacggcaactttccccgctccgctgattttccttgtagaaaaactggtctacggaaatatcaaacatggtaacgagcttgaagaacagattaaaactggggtgttgccccttgttctcaatattcataattgtgcggtcagtttttccaactaattccgcaacataggcttgcgtccagccccgttcctcacgggcctttttgagagccagccctaagccatgaaagtcaaactttctctcgtcttggtacataatttatcaccctatgtcattgtacatttcaggtgatagtattggaatgtaatagaattttatgcagagtagtattttatttcatattattataatgttgccatgaaaaagatgttcatatataatgtatgtggtttaatgtaataaagtttaacacaatatacataaggagttgcctatgcaaaacatattacttattgaagatgaagaaaatctcaatcgtggaattagcctaaaattaaaaaaagaaggctatacggttttctctgcctccactgtaaccgaaggtttatatatatttcacaataataaaattgatcttgtcatttgcgatattggcttacctgacggaactggcctagacgtctgcaacactctccgcaaaaaaagtgatgtactttttctattcctaaccgccttagatacagaggtggatatgataaccggctacgaaatgggggctgatgattatataacaaaaccattcagtatgagtgtgcttatctcaaaaatcaacgccatattaaaacgtaacgctaggtcacttgatacggtaattcattcaggagaactcaccttctttttagacgaaaagcgtgttacaaaaggtgatactcccctctccatcacaccaacggattggaagttattgacggtctttattgaaaatccacgacgtattctttcccgcaaccaactacttgaacacttatgggatattaattcagactatgtagatgaaaatgctgttgctgttaatatccggcggcttagggaaaaaatcgaaacagacccctccaatcctgtttatattaaaaatgtgcgcggattaggatatgtctgggaaatggagtgtgacaccaaatgatagtcaaaaaagaggtttcacttttgttcaagctaattctgattttcttgtttgttatttttgccgctgaaattattgtactgcccaaaatagaacatgatatgttaaaagaggcaggcaggcaagaactggtaacagtacaacaaatctgtggggctgtgcttgaaaacaacccagagcttgaacaaaattttattttggggcttcgcaagccaacaaaacattggcaagaaaccggagaaaaaattttgaatcaatatggctatgacgagaatcatttactatcggataacacactttacgcctcttacctgattgcatggaaaaactggacagccttttttctgattaccgcaatcctgtttctgtttgccttgcttttatatatttatattaatatccgcggttataacctgaaattatcgcagatattagaacagtatttatcagaagatttctcttttgcatttagtacggaaccgattcgcaaaggtcgaattgattttatgataaatcaggtaggcgaccgcctaaaacagttaggacaccaaattaaaacaaaaaatacgaaaatcattcaagaaaaagaaagcacaaaagcacttgtcacagatatatctcaccaactaaaaacaccgatggcggcgttaaaaacatgtttttatatgtatcttgatgctgggaacactgatgagaaagccgaatttttacaaagaagccagacacaattagtaaagctggagcagttgatttccagcttgatgaacatatcacgtttggagactgccatgatctccctgtccgtacagcctgtatttctaaatgatttacttgtaactgcggttaatggaatttatgaaaaagccagaaagaaaaatattgaaattgccttgcaagaaattgaaaatatctccttacaattagatgagcattggacgagcgaagcgattatcaatgtcttagacaatgcagtgaaatacagccccgaatacagccatattaacatttccgtgcagaaacaacatttttatacccgcattgaaattacagacgagggtatcggtatacaagaaagcgagtataataaaatttttctgcgcttttatcgttccaacgagccagccataaaaaagatagaaggaagtggtgtcggtctgtatttgacccgtatgattctggaacgtcagggaggaacaatcagtgttaaatcagctccgggaaaaggcagcacctttattctgcaatttaaaaattgattgataaaaggccggagaatccggtcttttgttatacataagtaagctgtgctatcttcgggacaggttggcccgaagtatcccttctgttatacaacggtaagctatcctgtaaggttcctgtaagtattctttgataaagtaaattagggaagggtacgaaggaggtgaaacatggatacaacgttaattactaactattttgaactctatggtggtttggcaatctttgttattgtcctgttggaatatttgaatcttcctggatttccagccgggattatcatgccgctggctggtgtctatgccgcaaaaggaggacttagcctcttgtcagcaattactatttctgttgccgccggagaacttggaagctggatattatattttttaggcgcatatggtggaaatgccttcttaaaaaggtatctgaataaattcccgaagcatgaacctgccataaaccgcacatttgagttaatccggcgcaaaggttattatggtatttttttcagcaaactgattccgatgatcaggactgtaatttctatcccagccggaattatgaagatggattttacaaggtattctattgcttcgtttttcggcgtaactgtttggaatacggtgtttgtcggagccgggtacataattggagaacctatattgaatttaattgcggggaggtgagggaatgaggattgctatgatgacaaataattataaaccgtttgtcggtggagtacctatctctattgagcgtcttgcagatagtttacgggctttaggaaatactgtttatatttttgctccagattataaatccaatgttccagatgatgaatatacgtttcggtttccgacaacacaaaaaagaattgcaggtgcggttcctgttcccagtcttatgtaccatcatgttaagggaatcatttcaacactggctattgatttaattcatgttcatcaccctgttatgattggaaatgtagcaactcgtctgggaaaggaattacatattccggtcgtgtttacttatcacacaagatatgagcaatatctgcattatttaaaacctctgggatatttgcaaaataaggctaatgagggctctgtctttggaaaattaattatcggctttgtccaggagcaaattgtacaacgctatctcaattattttattaagaaatgcgatatggtttttgcgccaacagaatctattcaaaagcgcctaaaacagtatgacttttatacgcccgtaaatatcgcaccaacgggcttgccagaaaatagttttgaagcccactctggggctacagagattcgacagcgctatttacaaggcaaaaagtatcttttctgcactgtttccagattggcaaaagaaaaaaatctttccttcatgcttcaaggtattgcaaaagcaaaaaaacagtcaggagatattttcaatgtaattgtcataggtgatggacaggataagaactatttactaaaccagtctgccaacttgggaattgataaaaacgtattttttattggtgaaatacccaatcagatgattccagactatcatcaggcttgtgatttgtttctattttcttcaaaatctgaaacacaggggattgtactattagaagccatggccgcttatctgcctgttatcgcaataaacgcaaccggtgttgctgatgttgtggaaaatggacaaaatggaatactctccactgattcgacagaagaatgggcgaaaaacttagtctttattatgaaaaaccggaatgttcttacaggaatgagaataggagccagaagaacagcccagcgttacagtgagaaaataattgcggctcgtattttaagtcattatcaatatctacaaaaaaactatcaggcagaacaatggctttattatcatttaggcagaaactatcaaaccatattattaaaggagaattattaagatggatattattcttgaaacaaaagaccttataaaaacatatgtcactggaatcaatacttttaatgcggtgaatcatacttcaatccgcattgaacggggagactttgttacgattgtaggtaaatccggttccggcaaaagtacactgcttcatttaattggaggtttagattctcccacttcaggagaaatctggattgacaatgaatgtatcacaaaaatgtctgaagaagatttatctgcattccgcaggcgaaaaattggttttatctttcaggcgtttaatctggttccctcgttaaatgtttgggagaatataatcctgcctatcggtcttgatgataagaagccagatatgccctatctgaaagagattatcgaaatgctgggactgactgataaactcaccaatcttcctaatacattatcaggaggacagcaacaacgtgttgctattgcaagagcgcttgcaacaaaacccgctatcattttagcagacgagccgacaggaaacctcgattctaaaaccagtgatgaagtaatgacacttttaaaaacctctgctttcaaatatgagcagacacttattgtaatcacgcataatgaagatattgcacagatgggaaaacgtaacctgataattacagatggcaaggtggtggaagaatgaaaacagtttatcatttagcattcagccgtttaaagtacaataagggacgatcttttctcactgctattgctattgctttaatgacaacgctcctaatggctatcggcagttctgcttttacctttatccgctatcagcagatagaaaccgaacaaaatgctgggaattaccatgtcattttgaaaggagttacaccagaacagatttttaaattggaaaatcatactgatgtagaatctgttttgacaagggaaagtattgcctccatagaaatttcaaaacttagcgcatttttaaattatgaggtattaagaaaaggaagtattaaacaaacagaattaaaagaaggtaatatgccatcagaggcaaacgaaattgccgggcctcctgctctgtttgagcgattgggagtagcaccgcaaattgggcaagagatacagctacccttacggattcaagggggcgctatacaaaattttgaatttgtgattagtggaatcttggaacagcaagatatatctaatctcaatgtaaatgaaacacggcttgtctacggcgcatatatttcagaaaaattcgttgaacagaatgttatgccggaaaaacgtgtctataatgcttatctccgcattatgaatgaaaaagagtatgccaaagatgaaatcgaggaaatgtgtatagaaatagctgaggatgtagggttgagtaaagcggacgtttcctacaacgaccaataccttacttatatgactaatcccagtatagaagcgcagaaggtaatggttggatttggacttttggtgattatccttggcggcatggtaatttacagtatttattatgtttccgtcatatctaacattcaggagatgggcaagttaaaagcacttggagcaacaaagaagcaaatacggcggctactttcaacagaaagcatgacactttctattattggtattccgttagggattctgttaggctacctcataacagcggccatgtttacgttgattatatttacaggcgaaagtgaggtcgatacattttggtatcctgctgtagttcttgcagtcatagccgccgttctgctcacgatattagtttctatccgaaaaccaatgaaaatggcgtcggcaatatcaccagttgaagccatgcgatatcaagagccgcaggggaagaaaaagcagaaaaaatcttttaaaactctctctatctcaaaattaagttatgcaaatttacagagaaacaaacgcagaaccatagtgacgctattggcacttggtttctctggaattttatttatggtgactgccaatgtcgcaaacaatctgaaagcagaaaactatgcaagaatgcttatgccaaaaggtgactttgaaataagccttaattatgcgttgaacgatcaggaatacccggaaaataatctgaatttcctccaacaacaaaatttttttggagatagcttaaaaaatctaataatgtctattaatggggtggaacgtatagaagaaaaccatactgtattagcagaaccggaaaatgtaaaattagaagaacagcgggttgagttgaagggaatctctgaaggtgatttagattctttgaaaggcacattaaaacgtggttctctggactataaccaacttatacaatctaacggaattattttcacttgggatattttatttgaagaatatggatttcatattggggatacgatagaattaacactctatgatggtaataggaaaatcccttttactggtactttattagccagtacaaacagtagtgaagaaacgttcttaattgctgatgacatactggaaagcctgattactgatgtaaatcctacaacagcattatacattactgttcgtccagaaaaatttgatagcataaaaacacaactgaactcactgcaacagaataattcccatttttcattcaaagcatatgatgaagaaatgggtatagctgaacatgtaattcgttctatccagtttactatctatggactattggctgtgattggtattattggatatatcagccttgttaatactatgatcacaagcattttggtccgaaaaaaagaattgggaattttacaggctattggcttatcagacaaacagctccggcaaatgatacaccgagaaggaatgtttttcacatttggtacactattattagctcttgtatgtggcaacggattaggttacatattggtacgctttataaaaaacacgaaaatattgatgataaacaaatatgagtacccatttattccaacggttcttttaattgttgcaatctttctgggacagatagctattacattttttacgaaccgatatatccacaaacaatcattagttgaaagaatgcgagattaaaacgaaaaactgattatcattccatctgcccggcggcagaaaagaaaaaaaccgtcgctgggtagcacttttccatgcctatattgtatatcgcaacggcggttttgatttttcaaagccgccgtttctttatgcctcaatggggaggaatgacgactaattctggcaataatggcggcttatggaggtagccgccatgacacaaaataagcgccgacaaattacgacagaaatcttcctgttaaaaaaagtccgtatcctacgcagggacagtctggtagcttatacgaaattctttatgccataaccgataatgcaatttcatgcgcctgtatagctttttgctgtgcaggcgtttttgcgttcttatggacaaacctcgggccaacatggcccgaagcacagccccggtgccgatctccaccgcctctatttcggttgctcattcacccaacaccgaaatggaggaaattatgactactataaatctccgggactattacccgttttatacccacgactatttcattgacgtacctgacgaagtggcggaactgttcaaagaatttgaccgaaaagaggccgcctatcgtctgcgtacataccgccataaagcctactactctcttgaccggaatgacggcattgagcatgaggcgctttttgtttccctctctccccatgaactgtatgagcgcaagatttccatgcaggagcttcatgccgccatatccagtctgccggacaaacaggcgaaacgtgtctatgcccatttcattcttgacatgagccagacagatattgccaaagccgaaggtgtcagcaaaatggcggtaagctattccattgaacgcgctttaaagtccatggaaaaatatttaaaaaattctttggattgactttacagagaagcgatttttgaaatggtttatgagaggcaaacagcctcgggccaacgtggcccgaagaaaaatacgccttgactgcaatttgaaagctgaataaaaagatacccggatacgaagggttgatgtgtccagtgacaggcccgccatgacctccattgtcagagaatggggagagcgaaaaggctcatgccgcaggcaggccgtggctggtctgccggataaaacacaaagaccttgttacttgcgtttagtcaccgtccgagcgtgaagcggccttgcaagccgtgagccgtcgcaggccatgagaacgccttgccatcagaatggggagagttgagatactatggggtggacatgcctacacccgtccgggaatctgataagtaacatcatatcatggggagccacccggccttactgtcttgtgacaggccaaatcttccggtgcggcttccctgtttttcaagaaggagtttttcaatgggtagaacatttgaggaaattcaggctatggcggcagacccatggagtaatgacgcctgccgtggctacgtcatttgggccatggagaactgcggatttaagccgccagaaataaaacaggttgtagccgagttatacaccgtatttgactttaagaccattgaagaagcggccagtcattattatgaaagttctttttaacttcgggacaacctgacccggagttttaattttgcccattttaaatttcatctataggataagcctcaaaccgcatatgatgtagcaagcatacatagaggtgattgttataaaaagaggaaaagaaatctgttacttacttcaaaaagctgacactgacagtaatgaaattgctgaaaaaaaagaacatctgataaagcaggggtatcttgttgtcaccattatcgagggtgcggaacacatggagaaaggtttgcgggaggttgtgaagaaccatttccactaatcattcgcaacattgtgttattccccctatatagtacaatataggtataacgataaggaggacgatattatgatttcaaaattaacagatacccctgaaattatagatggctatgttcggctttccagagacgataataagcggaactactcgtctattgaaaaccaaaaaaagattatccaacaatatgcagaagaaaataacatgataatccgccacatttatgaagatgacggaatttccggttattcattcaaccggcccgattttcaaaaaatgatggctagtcttgataccattaacatcattgttgctaaagacttatcccgaattggcagacacaatgcaaaggtactactctttcttgaagaaatggaggaaatgggaaaacgtgttatcctgattgacgataactacgattctttttactctgatgatgatataatcggtatcaaaacatgggataatgaacgtcatgtaaaaaatacaagccggaaggtaaagcgaatcaagcgcatggagcaggaaagcggaacgcttgtcagccagacaccatttggctataccagacaccctctcaataaacagatgattttgattgatgaagaagccgccgctattcttaatctggaaaaggaaatttatctggacggcaacggaatacgaaaaacggctgaaatactttcagaacgtggtgttcccactcccagtatgatagataaagaacgtcatgaatcgttagggcttgtttataataagcaggtagcctatcagtggagttacggaatggtaaaggacacattattcaacgactataacaatggtgtccttagaacacacaaacgggaacgtgttacaataaacggtaaagataaaaaagttcctaaagaaaatcaatatatttttccgaatcatcaccccaaaatttttgatgatgataccatgaagctgttaaatgaagtcaaggacagccgccatcatagcaaatatagaggacagagagcccatgtaaaccttttttccggctgtctgtactgtaaagactgtggctggaaactaacggcaattaaccgccctaaccgtgggaaatattacgtgtgcggcacttacaataaaaagggaaagcagttttgtcaacatgcccaccttgtgacagaagaaaccctgatggacgctcttgttaaatatctggttctctgccgcgacagtcttgcagatattatccagaattttgacttgtcaaagctaaaggtagaaaccttcactcccactgacagcaaacagcgtttagaggccgaacttgaaaaagtcaaagaagaactaaaggttctcataacgcaaaaggtaagggagattaccgccaatccttccatgaatgagattatcactgaaacttatacggcccttcaaagtgataaaatggagcgtatttccgctattgaaaaaacgttgcaggatttaacaaaggagcctcatatcccctccaccacaatcaagcccagcttacagacggcgctggacattctgaacgaggttcttgaaaagaaagaactaagcagaaaagatattgaggttctggttgagaaaatcatagtggataaggacggcaacgtagatatttacctgaaacacggccttggcaaccttgccgcctatgatttcagggcagacaaagaaaacctgaaactgactatgctgattgaatctatccggcttctggaaaaggacgaaacaggctttacctcggtaaaattccttgccgacagcctgaaagagatgggctatcccatgcacaaaaagaagtttgtgacttacatggagcacttacttgacttagggctggttgagaaaacaggaatctaccattatccctatagaatcgtggcttctcgacagcaactgcgtgatgtggaaaaaatgttcatcgtggtagggcagactggaggaatgccggaaatggtcttcgaatacatcctgaaaaagaacggcatcgatccgcaggcagacctgacaattgaccagagcattgatttcggttccaccgcagccgcattttccggcgggcagggtgattttaccgtggtgtattattaattactacaccaatcaaatctataaggaggaaaagtatgattttacatgatttgtattatgcttgcggagacatggattgcactcataaagcaatcttaacctttggagatcgaactactttggaaatttccgtaggagaggccgtggatagatatggacatttacatgtcctatgctttacaaataaaaatgaatattgggatataatcttgaaagaagatatgaactatctttaaaatggaaaggagagaggaaccgcgcctctctctttttttaatgattatcagaatttaactgccttaaatgacagcggagctatcaagggcatggatgccagggaggacggtgtgtatattacataccataatggtgccgatacagtgacaaaaaaattgggtagccctgaatatacattaaggcatgcggccgacagcaacaaatctccgatagatattacaataccttcctgtgaaaatgcattacttgtagtggctgccaatagtggggctacggttgacattaatggaaatgtttcagcaggttccggtgaaattaagagtcttggactacataatttcaaagggaacaccaccattaacatggggcttttccaggttacttcaaaggctggatgcacggttacttttagtatccctgcatacaccaacaccatgactgtaatgtttctttctgcttaaagcccgctttaccttgcatagacgtatgatgtagcccttgaaatataatttgtattttctactccgtaatgtgttattttaattttactttttgaaatataagctgcggaatagataaagcctgatgtataactccccccatcaccatacacataccttatcgcatcatccaatgttgcaacaataaatcggattgacagcatacgcgggtaagtatcctggaatttcccgacgaccataatttcttgatactggctgaaatctatgttggtttcggtatctccagaaattgtggcaatgagcttccactgtaaattctgatataaattcactctatactttatgtatatttatacaaaattacagaaataatttgctgattttatatcagaatttaggggcactgaatgacagcggatctatcaaaagcatggatgccagggaggacggtgtgtacattacttatataccggctgcaggtgctgatacagtaacaaaaaaattgggtgaaccccaaatagcaactttttctcttactaaaaatgcaggacacccaagcttttcttggacagcgcctggaaaaattgttgctgccggactcacaagctgtcatagtactgccgatccaggaggtaattatcccaccggattaagttgtaccttttccggaaatgttgtcaatatagctacttggaaatatggtggcacagttagcgtgtcaggtttcgcagtatatgagtaaagtaatcgctaaagcccgcattagtataggagaatcattaaacaatcgcttgtccggtcagccccgctgacagtacacttaatggattcttcttcaacctctaaaatgcttaattttgtccagaaatagagtgcagtccatatgggtatatgctccgatatttttgcccccgtgaccgagatattcaccgctgtgcccgtttgagtgtgcccgccccatatcaacccacattttttgacacctgcaggaatcgtaaatgttgttgaaaagtaccccagttttttttggtaggtgatggctgatttaaaagggagcgctgaatctgcacctcctggcttatacattggtgttccatcggcggatacggaaaattcaaacccacctaaattctgatcataaaatttttacctgaatattatcctcaaaaaatatgcataaataatttataatatgtataaaattgcaaacaaaaaaagcgccgaagcgctttttccgtagtacgtagtagggtatacacccagataaataaaaataacattaaaataatgtcaatccacatccctgaatagtgggatggcaaataagtcttacaccatttctaaaaacttttaaatccacatatcccggaattggcaggatatgaactgttgcaaaccatcctttgctactaaactgatgataccatgaatttaatttttttgcaagtacaaaataaaaatagaaaaactacctgtgatactttttaggcggaatccaggtggtttttctattttggggtgataccaataattatgatagcataaaattgaagctttttcaagagtcttcccccgcccatatcatggactgaagtacatgaaggatcttttgcgctgccgtatatcctgctgtgagattttccatacaattcaactggacttcctctttcacgaacaaatgcgacatatctgatgcatatctaatattacgtgggtatgcgtccggtatataatccggttttccagttatcgcacacgtcccattttggggaagataactggtgtaccactctatccaactctcagaaattgtggttttcattcccggcaaagcgaatgaaatacatgctccttctgaggcctggatatttgtcaggatgggagccaactccatccttattgttccccgacgaagatatttatacacggcgtatgcaagtagatcatctgtttccgaaagataatttctcagctgatccatataagcgatgtacctcttttctcttcccggagtttctgacagatacgtaatattgtcatggattgcatgcggagcaatattagacgttctggtctccgattgtaccgtgcacgggatcggcataacttcatttattttctttgcggccagcagctggccattgggagaaaggagaacacctatttttgcccgcgtcatagtatgcgctattggggcaacggttccggtcctccagctattatcatataacttgattaactcttgatatatcatccccagccctccatcgataatacatttccgtttccatcctcccaggcttcagcgattggatcagcgcctttcgctatcaattcccaatcaccagaattaatgaatatatccccaagcttttctccttctttggtgacttccacaagatcattagagatcaatttatactgaatcccatttttttcaattacttttcccattgcatgttcctttatttttattttatccggcgcaccacttctgcgccgttcatgatgatttcaccttcatcctctccccattcccatccccaacgggattcaatggctacaagatatatatgtttgccgggataatcagattccaaggcggcgcgataattattaagttcaccgctcacttcctcaattgtcccgtctaaataatccagaaaatcagattcgtcagaaacaaatatcgcgcatgttcctgaaagctcttcctcggtatcaatcccaccatcccatctatggcttttcggtatttcttctccgattgaaaattctctattatcaaatctgattccccatatattatacattgcgtatctcctatttgtttgctataatttttttgaacgggggagcggtggcaagcccgccctcccttgtttcttccttgcctactctgtaggcttatttttttgcaccggtttgtacttttcttcgccggtttcgatgtagagtatgaaatcatttatttctttttcatcccaaccggcagctctaagacctaatataactcttgatgcttcctgcatgttcatgtcgctcatctcttcctcctttcccgcttgcccgtattcattaaggattgttcttccttaactatctttattatatactattcgtacgaatatatcaagccttttttattataattttctctccttctaatgatattatcacctctttttcttcttgcgtgatacccagtgcctttacaaattctgtcggaagtgtaagtcttgccatcatggcatttttacttgcagttcctccgggtttgttaaataatatttttctctttacagtttccatgagcacctccttttttattatcttacattatttgtacgaatgtttcaatggcatactatattattcgtacgatttttacatttttcattcgtacgatttgttcatttttaccattgttttattcgtacgaatagtgtattatagaattatcaaaaggaacacataacatacggaggttaagagatgaagaaatataatttatccgcaatcatgaaaagggcatgggaactggttaaatcagttggtgattccatcagcgaagctctccgcaaggcatggcaggaagccaaggctccctccgttatcaccatgaacgtgatcggcaaggaaaccttcgtaatcaatacaaagacaggtcttgtgtctggcaagacatacaacagtcgtaattttttaaaagacaactttaatgcaaagtgggataacgacagccgtacatggacggttgataccagcaaacttatggcagagctggaaagataccccgagtattacaaaaaatatatcgttgttgatgctccaaagtccatccgttttacagagatggtaaaccgctgggatggtttctacaaccacacagtatatatggaaggcacctataattatgtgttcatcggatgagcaaattccctacccgacggggatgcgccggaagaaatcaatatttcaaggaggattagtatggcattatttgtggtttatgtagtattggatggatgtaggggattcgatggaggaaattgttatacagaatatctaatcacccaaagtcgatcaaaagctgaaaaggtatgcactgatttgctcagaggaggaaaggacgcattctgggaacaaattcaataaaataacacatatcccacccggcggggatgcgccgggagaaagaaggaaaaatgaaaagagaagaagcagaagaaagagcaatgaattatatttgtttcatgaatctcggacaaatcgaaagcgaatgccaggaaagggggataaaaatttcaaaaaatcgcgctgtcatggaaaggaaattaattgctgctttgactgttgagtttatgcagcaacattataggaaggtttgatatgaaaattgttttatatgagaaaaagagggatgagcctgactctatgtttcgtccggctaccaatgaccgtcttgcatggcttatctatttcatttctcaggtggaatgtgataaggaaaccgctaaaatcaggcttgatgcacttttgtgcggtaaacaaataaatacagacttacgttcatttctgctcaagaatgttgattgagcataactcaggaggccggtacttggaaggttcgactccttcccctcctttacctcaatatatgaggaaataaaaactatatggccggcccgccgtctcagatgcgggcagaaggagtacaccatgacaaaacttgcattacttaacacatccatccttacaacagcgggagcttatgagctcaccgacattacactggatcaggcccgccagatggttgcagataatgccgacaaccttgattccgcagttggacatcaggctacagcggatattatgaccgcactgcttgacattgacatccctgtcaaccggcagttgtttttgcaggagattggacaacaggcacttgttttcaagctcaaggggcggccgcaggaaggaataatcctgacggcagcggatatcgaagaaatcggttataaattccaggttcttatccgcaccaggtaacaaaaggggcagctgcgtagccgaccaaagcaaagcgcaactgcccacccattacaggcggatatattatatcatagccgccttttccaaaacaaggaggaactatgaaaattttacagatcaacgaaattcggaaggcatatttccttaaggcttttggcagggagcctgaagatatgttaataataagcatgggggcctgcaactataactgctcatattgcaagcgtgatggacagtttaaaggaaacggtaattctatcctcaacgcctatgatgttgcaatggatgagatttttggcgtgatagacaagcatataacagctggccatagaattaggctttccggcggtgatccgtgcatgtttccgtcagaaagcctgcagattgcaaaatactgctggaacaaacacggtcaaaaaatatcattggcgcacaatggtagctccccttccttaatctgcactctgcttccatacttggattatgtcgctattgattttaagggcgcaaccccggaggaaatcgcacggcgcagcaacactcttgtcaatccggccagcattggcaatatcatgcagataattgatatgtgccagcagacgggagtactcgttgatataaggacggtcatttttggggatacggatacggacgacctgggcagtatcggccacaagctttccgcttacaataatgtgttttggacactccgcaaatacaatcctgtaataggatgcgactttctgccggcggaaaatgatatccgagttatggcagaccggttaagcaatacatacaacatccccgtaggataccgggataagtggaccggatgcaacttttatatttcatatcagttttgcgcctaaaaaaagagggctggttaaccagctccttacttgattttttatattatccattgtatattatggatagaatacataatggaggggaataaaatgtttagagtgcatgcatatggtgaccttgctttatttgcaaggccagaattaacaatagataaatttagctatcccatgatcaccccgccggcagcgcgcgggttgatggaatgtatatactggcacccgggagtcgaatggattattgaccgcatctatgtacgcagtcaaatcaaatatgtaaatacatcctttgattcttccacattcgttttcgcattacaaaatgtagattatataattgattcccattttgtaataactgataaggctggtcccgcggacaacccaggtaaaataaccgatatcataagacgtaggctggaccgcgaaaactattataaatccccctattttggctcggccgaatttcctgcttatgttgagccttgcccatttaaacatattaaaactgcttatactggcattttggatcttggcctaatgccatacacttatgactataccaaaaacactccctcaccgtttttcttccatgcttgcttaaacgaaggcattctggatttaaaacgtcctcccaaactgctcagataaatagtaaaggagcgccgaataagcgctccttatttttttattctaaaattttcaccttatgaatgactccgcgcagccctatggatgcaagcttcgcttcatattgtttcataaatttttctgcttcttctcttgtccatacatccgctaccgacaatgtatgtattacccccggctcctgaactgcaacattgtcaaatcgggtaagattccaacgctcgacgaccgcgcagagcttgtctacatagtccagggatgacgcataatttcccgccttaattatctcaaaagccctccggtaatccctgcagccaataactccggcataccgcaggtcacttcctgccctggccccggccaaataagcggaatggtcagccagatatgccgacaccgatgggtaagcccggaaggccgccgtcactgtataatagctaccatctgcccgctgctctgcagtatccttaatataggtccggccgtcccaggcagacgcccaagtattaccggacagctccgctttcatcccgcccagattaagcgcctgcagagccagctccgacttgccataaccagactctaagatggactgcgctgcggttacgcttgccagaatgccagatgtctgcatatctgccgcagccatcccgccaatgtactccacaaattcttcccggctcatcgctgccagccttgctgcgtctgccgtagtctctgctgcttgtccggttatgccagccacaatagccgctgccatcctgtcggcactatataacgagacatcttccggatcatccacaaagcagcactcaaccagtagcgccggtgccttggtatgtttcaggacatataatcccggacgctccttgacgccacggttacgataccccagcgcggctatgctatcggcaatctggtgcgcccgtggaactgccctggaagcattgttatacaccaggacttccgttcccgttgtcttcccatcagcctcgacttgtgcaccgccgttgaaatggatggacacatccaaatccacctcatgactattacaggctgccacaatacgtttgagtacatccactttgcccgtgccgttgtcgcaggtacaatcatgcactgtatggcccatagcggtcaattgtgctaccaccctatctttcaccgctcgggcttctgtagactcccgtataagccccacagcgccgcaggcggtcattccatccgggttatgcccagcatgtatattaatcctcatagtctttcctccaaaaaaagaaagggacggttgcccgtccctcatgtttttactgttttcccttcagttcatgcataactgtatcgccctcaattgccggctgtgtgaaactgttattcttccaccatgcccagagtgatgctccaacagtaataaccgcagatactgcctggcctacttcctcattagagaaaggaagtggactctttccagcaatagttagacactgatttaccagcgccacacccaacacaattgtccttacaatagttcctttttcaatttttcttttcatttacttctccttttccaagacctgtaaacgggtttcatgattattcagtttttcatcctgttcctcattgtgttcccagattctccgatgagattcatggtttttcacgtccatatctgccatccgagaatcaaatttttcaattttttcagataggcacttcattgtaatattaagttcagtcattgccttcgtgttaccagacataggcttgtagacagatatgaagaggtcaatcaggacaacaatgacaagcacaatgtcccatctttccaagggttatacctcctgattttctctcagccacttctctgtagctgccttccacagtttcggaatctcctccaatgttttttcacctgataaaattttcattccgtaaaatctacccattatgcctgtcctccttcaactttttctgcaagactggatgttactattcccagatcatcaattgctccgtcctgcacgccctggcccgcttccagtgcagcaactctttctctcaagatttccaattctgttttttctctgaggtgatattccgttagaattttcccatctgcctgtaccaccgatgtttcgtcatccaataccagttcagaataacctcctgaaaattctccatcgatatgcgtttccacttttttaaggttcgcattggtaaatttatcccaagtagataccatctctgctttggatgcagataaaacacgagcattacgtatggtggaattgtcctccatcacaatctcagtaccatcattaagtactaaagtacgaatcataaaaacctctctttctcccggattatccgggtaaaaaacatataaaaataagccctcaaagaggacctgtcaacaatggttattagttgttaaatcagaagtcagtagttattcctccgtatggcagacgtttgtcaatttcttgtaaacatcttcgtacaattcctgtttatcgccattgaatgtgtattccgcatagatgccgtccccgctgattgttgtagatgcaaggcacttataattctgtaaagttttacatccccaaacgataaatacatctcctaaatcaatctctgtttccggtctatttttgtgataccattcaaccaactttttctgacaaacattctcaaaatgcttcattccagtaataatcatgttatcctctttctccggcactcagcagccggcagcttagttgttaaatcagaatttagctggccttccgactgtaaaggcaggcattacggaactaaccttttcaggtggaaataccacccttactcataatgccggcttcccggacacaaactatgctgttatgtttatttgtgataatgtacgcatgttcccgcgaatgagcacaaatcttgatggtaataaaacaacgctttctgcaagcgccgtaaatggttccggcgcaatttcgcacctcgaggggaaataccgggtcatgtggattgttgcccggagcgtataaagctggcttaaacacctataagcataatataagtataggtattggtaactaccattgacctgtttaccacaagggatgcagcactgttgatatattgcttcgtatcatatttggctatataacaattattatattttgtataggaagcaaccggcactgttgcaccatttatctgtagtttgagctgattttggtattgtgtaaaccaattaccattggttaaaagccataattgtgccttactaagcgtgaacggtattgttgattgatcgccaggaaatgagtactgcgcaaaatatacctcaggattactaaatgggacccaggctgcatccgcacctgccttataactcggtatgccgtctattacatcaaatttatatccgtttaaattctgatttaagttatccacttcgtccttcagctgctttcctttccgggcagtaaataaatagttttctgcagttgttgtgaagtcgtcggccaccttataaaaggcagccggtcctaaatcagtcaaccattttgcaatgtctcccataagcgctttgaatcgtgcttttgctgttaatgctttgcgtgatgagcttaccgtaaaatttacgcttgcctcggataaatcgcctccattattaagcggaatccctgctgtatcatatgttatttcagtatcgcttgcggcgtaatacctatttcctttatcgtcctcaaatactcctttatatatttctgccatttattatgcctccactaattgtttgaggaataacctcacttcagaagcttggtcatagctcttaccaaattttaacttatctccaggatctcccttgtctcccttgtctcctttatcacctttaggtcctggtgaacctgttgcccctttgatatttccgatatagatccacttagctacggtggcggcgccggcagttgtacatttatacacatatccggtacttgtgttaatgaacatatcatttacacgtgcgtttgatactccactattagaaaaaactgttgccgtagtagagtttcctgtaattccggtaccgttataccacatactgccaggggtgccggccgttccctgcgcgccagtatctcctttatctccctttgcacctgctgcaccagtatcaccttttgctccctttgcaccttccggccccttaatgcatcctatgtagatccattttgcaacactggcagctcccgcagtagtacactgatatacattccctgtacttgtgttaagatataaatcatttactcgggaattagttactccactaccgctatagcttgttgcagtagtggatgtacctgtgatacctgtacccttataccacatgcttccaggggttcctgctgcccctgcagctcccgtatctcctttatctcctttgtctcccttgtcccccttaattccttttatgctacccgtatacgcccattcagctacacttgcagcgccgccttttgtgcatttgtagacatttcctgttgatgtattaagataagcatcattagctaaagcagaagatattccactgctgctaaaaattgtacccgcggtcgccgtcccggtaattgcagtaccatgataccagagactaccgcgctgaccagtagcaccagtattaccttttgcaccagctgctcccgtatctcctttttgacctttcagctgaccagaatcatatttttcctgaaatgtctctccatccgtgaaataaaccagatctgctattgtctggacatctgcatcccccattaaagtatcaccattgtataattgcacgcgcactctataatttgccatttttgccctcctaaatttcgtctaatagcctatatcccaccgtgggactggccataatatttgtatttggaataatttcggaagctgcctttttgataaaataaaaggtcttttcctttctttcaggtatggtgatgtcctgatctgtcacaacgatattcactttttcttcctgcagcgccgtaatctgcttatcaaactcttccttgctgataagactctgtgggctgataaccgcggtaatcctttctactgttcctatgacaacgacaagcgtcatttccagaaatttggatatggtggattctgcatcatatatcatttgtggatcatctgacatatccaagtatgcatataaaacttctccttcatctggatccattgcatacactcccgcttccgttaccgtgaaggcttctgaaacccctatggagctcacctggaaccggatggaggcctgactacgctcagtgtccgcttttatttcggatatttcaccgtccattctataattgtttagatcaatcatacttgacgggtcatatcctgatgggactttaccaattccaactccaaccttggaaaataccaattctccgttgcaggctaacagctttgttatgagcatcagcccctttttggttataactgttccattcaagtttttacctcctttggcaaatacgtgcgttctacatacaccagacctccggcggcacattgcatcggaactgatgcagcaaaatgagaattacctttgtatggttgtactgtcatcttcacatatttgcaaaatacacgcccaacatatattggcgctgatgtagaatgataagtccgataaaaaatacgcattcctacgccggcagcttttatccggtgcatgagtgctgctatactatccgctacagctttgtgttctgcatccaacttatcctcatcaatatacagatatattttagcgggaaagacctcatcaatatccacatcttccggagctacattaaaaagtactgccgctgcattaataatggtatccaggttccctgcagataacatggagatgatttttaccttaatcataatccggtaaatgctatctgaagcggttccccgcataaccccatagttgctcccatatctgtccaggacttttccctttgcctgatccaggtcatcccatagttttacccgttcagcgttttcctttacaatatcgaatccccaaccaaggacactgtgcaaacggcctatatttgttttcgggggctggccccgaggaatatggattaaatcctcccttgtatatgcgcttgtcagcatttccaacatctgcgtaacaaaattcatgtgaacaccaccattccctcggatgtaatagctttctgccggatacctatctcaatattactttccccatattgcccggcagcgctgccaatacggggcttgaagtctaccactcctggtactgcgcttattacgccaggaatagaaataaaaataacattctcaccaattgccaggcctccatttgcacttccgcctatataattcatgagtgcctgtacgatggtatcattcccctcaaaatttgtgtttgttacgaggttagttatctggatatatatcggtaccagttcgggacgtgagaaatacacatctttttcctgttttgatgcagtcagaatactgactgtctcactgcccgtggtctgcaccccgccagcttttctggtatatattacttttgctatgtcttcatccagaccgccataaaccactgcctcaatactgtgcggtggcaagccatactcagtatcaggaatatctttgtcgttctcatacacataggctgtatatataccggggacttcctgcaataaagctgctcttattgcatcagcatttaccccaccggaataatcaaccgaattataatagcgctgtctgtactcttcatcggtttcgcgttcccggccgccgataacatcagcatcgttatttacagatgttacacctgccactgatgcaggattcacaatcatattgatagtgccggctggtgtgttatactccactccgttttccagggcctggattaacgccagtactttccctgagcttcccacctttaccttggccataacagaatactgcaggccgcctggggtacaaaccagatagcctgcaggtattattgttccggcttttgccgtgatatttacatatccggtcgcttttcctgcagatagcacctgcaatcctatgcttttcccaagattataaagggatgttccgaccgatgtatcgatgaaacgactattataaacatcttcaattaccgaaaacagtatatttaacatccatgcataaattcgtaagaaaattccaattggagagcgtaccgtaagatttactttatccgggaataattcccgtgctttgtactccagggcattcagaatttctacataggtgggacggtaaaatcctttttcggttaggccccagttttctgcggtaatcatcttacaacgtcacctccgattccaacgtatcccctgccgccgttacggcccggaatgaaacacgcatatcccgtccatcttttgtcgccgtaagatcttcaaccatagttaccgctgattcctgatagatactttccctaaattcttccgctatgtcctgcagctctgtattttccttaaaaattttttcataatcggtaccatggctgggaacaagtgggaaatcccctattccggttttaaggttcatccggatattttgtgcggtagtatctatccctgacaaagtttccattatcccatcttctccaataaccagatcccctgtttcatcaatttttaaggttacgttttgtgtcatagctatccctccccgacaggagttccgttgactaacagttcccctttgatatttattttcccatggatagttattcccttccggcttacctcaagataggtttcaggatttttatccacatttgttttcacaattccacaaaatattggatatgcggccgcatggtagttttccgtctgcggctccgtttcctgtcccgatagcagtacattatcactgtcctggtcaagatacacaatcaatccgcagtctccttcttcatactgcggacgaatagggaaggcggcgcttccaagttgcatgactggtacccgcagaatggggggctgggaaatataactgccttcccgcagacttttaaccagcggctttacgtccacttccattttttcaggataggtggcaataacctgcaccagggccgctacatgcagttgctggaatattgcatttttttttgcttcttcataagcatacccttcagatctattcatgaaattttcaactccatttctgtgtaccagtctcccgttggactccctttatggctaccactaaccaccatatacgttccatttatactatgagattgcacctggacaatatctccaggacctattctatggtttagcaaacattttctttttattgtctttgctttttcgtttttcttttcttttgtttcctgctcatccgtggctattaaggtattatctttttcccctccggaagccaggagtccggtttccggcgtcagaagataacccatgttgattccttcctcaggattattgatattaatctgattattcctgattaatagcctgctgccgcattcgtttaccacgatctgctttaatatatcctttaattttccctggcaaactcggccgcgtggataggtgatatcctctacaagctcaaatctccctatttccagcccgaatatagtcagaagatccaggacgatattttttgccgtggtatccggcagatatgttttatttatggttttccctagccattcctcaagtgctgtggttgcggatatctcggtaatccaatctgtaccacttttttcgctgctcacggcattgactgccccaacaaatattgttccaatatctccctcataccccgcattcaaaataataggggtacccctctgaatattattccgggtaccctctgacaaattgtaaaccttaaatgtcacagtctggagctcttcagaatccttgaaaggaatctcaaactcaaaataaaaaccgttatccatactgtattgattagcccctatctggatggttgcactgcgaataaaaaatctcatttttcccgcctttcatgcaaatacagtttaatcgatttcccgaaattgtcttccgtgacttccgtttcctttccctccaggcaatacggaataataaccggaatcggataccggtcatcttctatactgccaaacatcggcctcccatatctgattggatccccataacacaatacctctcctgtggctgtaatagacaagtccacagtataaaacttcccttggtcattgtatttgacattaaatgtaaatgtcctatcttccagcttaatgctaaaactgtaaggtaccttatctgcagcaatcggaatgtattttacggtatgggcagcttcaataacatttaaccccatcatctcaccccatcataaccggcagttttccgtgatgatgggccgccgctgctctttccattataagaatttacgtaactggtatacgcatttcccgtgattgcttccgataccgttgttgtcattcccgcatttttcgttgccgcggtcttatttcctgttttttctctggcatcatcctggctcatcagagtttcccccatctcgatatatgcgcttgtagtaatattggctttctgaagggtggccgtaaagctacagccacccgcgtttttatgttcggaagtaatgctcaggttggtaataatcagattatttccccgcacacggccagaataggtaagcaaatccctttctttccacatacgggtcaatctgtcagcatcagcatttccgcctaccaggataccgccaatgggaaattgttccgaactttttattacatggtcattgatagaactgccgtcctcaatcgcattttctgtcatcttactcgacattgtaatgccttctttattaatcgttcccgtatccggttcaaaccgaatacttccacatttttcaccggttatccgatatcccaattattaccacctcctatgcaaatccctcctgtatagccttccgttttgtttctttatccatttctttttttattaatggagggaattcgttctgtacaattctgcggaaggattcttccaattcgtgcagcttattttctggaatatctccagatattgttactgtcacattgagatttatatccataggcgccgcactgcctccggatacattactaagcagctgccgactcttatcagccggaataattgtacttccgctgggaaggtatgcaacttccccgccgcgctcattaatatgcgtccaaccaccaggaaaatcaggtgttccggaatcattatgcgggagatcatctcctccgctgtctcctccgtttccacctccaccaaacaggccagcaatttttcctatgactgttcctacgccttctgctgcataaccaacgatttttgccaggaatccgacaatatttcccagcacggtgcctataacctgcagaacaggagacagggccgataaaagcggtgatatcgcctgcaacatactctgtaatcccggcataatggccgataccacattttctaatattggtactaccggctcaattactgtgctgatcaaagtactggcaatttccaccaatggcggaattgcagatgtcgcaatcatcgaaataatacgtgcaaatggaggtaaaatagtctgtgctaattttccgataacagagacgaccggagacaaagcactcaccaacggtggaattgctgttgtagctaatccaataagtacagatcctattggttccgcagccccaaacacttcttgcagagtagatatcagcggcggcagcgctgttaccgcaaaattaattaacccggggcctgctgtttccattccccgagccaatttatcgaaaaggcctgtaataacaggttctacaacaggccatgcattcaataccgagcctacaattttatcaaatgccggtgcaaatttagcgccaattgtagaaagcatatctgttgcttttgctttaatggactttatcccatttgcatatcctgtttgggcgcctgctgcctgtttctggatagaggtactgttttccagcagcgcattcattctcacctgggctgcttgcgcatctgacagatcctcaatgttcttgttgagtcccatactcagtgcagtctgctgcaacactgtatcatctatctgcacaccgtattgggatagagccgcggtattccctgatatgtaatcctgtactgtggataaggcctcggcatcatccatcttaaaagcagcaccaaaatcataagcaagagatgtggtcattttggacaggtcgtttgcgaccgctcccgtaattccgagttcctggtacattgctttgttttgcacaaggaaatcttgtatctctgttttactccggttaattccggaagcaaaattatcagcccaggcggatatacccacatcatcagcaaaaactgaatcgaatttggctccgacatgttcagtattttttgcaatttcaagtacagaagaggcaaatcctttcgctgcctccattcctgcttttaaaagttcaataccggcgccaagggcagcaaattttcctacgacaccacctaatgcattcttgatactggttcctgcattttcgccggagtctcccatgtcctttaggtctttttccgcactctcagcatcatcttctacatcatttattttacttccggctttttccagggcatcggatagtttatttttaatggtacctattggatccttaaatacctgagatactttctttgcaccgatagcaagttttttctgaaaaccggttgctttcttttcggcatatccaaaggctccctgcataccagctttaatggctttagggaaggaattatactcctttaatgcttttcctgcgctgcttgcaacagcatttcccatgctggatgcttcagcgcccattttgcgaaatccggacctggcatcgtcgaaaccatttccgatatcagttcctgcccttcttgcctcagtacccatcccacggaaaccatctgctgctactccgattcccgcttttatccgggttccgacttcatcactttcttgttccagggttaccatatcctccttagtatcttcaatggttccctggaggtctttcatttgtgtaacggccttatccagactgctaaattgcatcccgaaggtgatatttctttgatcagccatctacaacatcacctccgttcttccgctgtatttcctcgttatacaataactttgcttcgatagcttctaggtattcagatagatccatttgcatcatttctgtataactcaatcctgcgcctgaatagagcaggaaccaaaaagcttcattttgcttggctttttttctcgctctatctgtattactttcttcctctaagaaaggattccacctccgtcagcagttgttcggtaacttcaattccatcatccatatcgcagaaatattcgattccctgagctttaatttccggtggttctacaacaacatttttaaatatttcatcaacatatcctgctgtattcttctttcctcctgtcatcccatgccggtcatttgcatcaaaataccatcttggagaaacactctgcaaagtgtaatcctgtccgtttattgtcacctttttttgtcttgccatatattttctatagctcctttcacttaatcccttaggcctgtccggccatattttcttttccatccactaatcctcaattactggtgcaaagatcgttacgtcgatacttcctgctgtcttctcttttttattgtctggtattttcgtgatgcggcagcggtttgcacttgttacttctgccggcgtcttatttgtatcggaaatcacaacagtaacttcttttcttcccttggcaatccccctcaggaaatcaactgaggaagaagtctcctgaagagataaggtaattgttcctgaccggtttgcattttctgaatagaccacatctccctgtgtgcctacggccgtagaaacaatatcttcatttctggttattacaaccatagatgcatccgaaaatccggtaataatccggccgtctactataaccgatactttcatagggttataatttgttatactgctcatagctgcctccttataattctacagataaagtgcctcttaccgtggcactgtgtactgctccggcaagctgcgctttccatgtaatgtcaggcataatccgttttctgcgctgctcttccgtggaatcttcccattttggaataactacagaatagattcccatacctgtgctctggtcaacagcaataatattgttttttgcagcgctgttcatagcctgcagaacggcagctcctacttgcgtaaaaccattgtcaccgtagggaatgattggattatccataaacacatcataaattcgaccgcggatctcttttgccagccaatcaccgccgataacggaatcaataaattctccgtcagaacacatgccatttttaatgtaattgcgcttatattcatttgtcacaaaattcacgctgttattttcgagcgcctttatttcatctgccgataatgccggataagtcatacccgcgggcatcttgaatttccaggtcacatattgtggataccaagggcctacggcaccaatccaggcagcatcggcatgctcatccagattttcagtatatatcacggcagcgcgggcatgggaaaccttaagttccttattgcttgtctgtccgaaataaactttccgatgatcctccactcctgatttaagttcaatttctgttggttctgaattttctgcaaacgctgcaagagcttctatgtattcatcctcagatttatcagtcatgaaaaaataccaatcattatccgatttctgatactctttgattgcagcaataagagattccggcgttgtgatatctgcaaatcccacaaccttgatactctggataagcttttccggcactggccttgccttttcctgcgaaaacagggctttcacttttttataaccggcggattcttttcccaggccggcctcagccgcttccagacttgtatatactgcggcctctatctttgcatctgtcaagataagaagaatatccagtgtatctgccggaagcgctgctgtatcccgtttcacgataactactacatcattcattcttttttcctttcgctataattttttcaatatttccggcagccatcctatcatctctgacatagcggagtaagacatcaaatccataacggtttgcttcttcatccaccataagtacatttcgctgctgcacattattgacatcttcaactacaatccccgccatggatagctcatccctcccagagagcaaaaaccatccctgggccttatctgctatttccattgcttcatcttcgccctgaatatacattccgccttccccataccgtgactgactgcaggcggtgaaagagaatgacattcctgcccgttccctgcggtgtagatatgcctcgttcgcttcccgctctatatcgtagtgtcccatggtaggttccgcaatataaggagaggttatgctatatatcagatatggcagttcagcttccggtgccacctgccctgaccggtataccctcaggcccaagtaatcctccagttgcttagtcaccacattacgtacttctttcggtgtcattcttctgccttccctttcgcttcaatcagatacctcttctggggatgtatggagttatatcccagctcctgttttactgtataggacatatttccttcaggatcatacatctgcgctcctattgccaggctgtatccattggtatacaccttttgattgtgcagactgtatgttccgatttcctcccgcatcagatccttgcttgttaccggaagaataactcctttaaagggtatacgttcttcagttcctggtacccactgtcctccattttcagaatcataatcaccatcctttttacggacatcgaacatttcatgcattagtccctccggaatttccggccgcgcataagcaaatgcttcaatcatagtcaacctccttcaattacatatgtaattgaatttcgtaatctcccgctttccaccagcgggctattgggccattttgatgtagcctttgtgatactaccctttttgtcaaaattgcttggagtattcaggtacatttggatacatccaacggcggtcattcctatatggtttgccgccgtcaatgcatcccagctatcaaaaataatccccgcaacagcttttttgcaggcatcttccaggacatccttatttgcatcatatccagcccttataaaactccgttctggtatatccactgatgggaagagaataaaaagatattcaatatcctcttcatttttttctggaggtttgcccggtccaggtttatgcagccctggctttgtatctttcggccgtccagcttgttttggtgcaccctttcttttaggactgatgcatccaaacaaatagcccgcctttgaacggataaagaaaagtccttcaaagtcccgcgggctttttccgatagccttatctgctattggtattgccaaattgctgacatttttagcttttatcgttgctccaaattcatgtactccggcaatcgtcaggatatccgctggggtgtctttttcttcccctgcagccccctttgtattcccattttggatccctacatggattgtcaacccttttagcttctgtagttctgcaattattctttcgatttccggagttacgttgtcttccacttccatcagcattccacccttttatagctattgataatttcctgtacctggctacccagctctttatcaaatgtccaggaaacatcagaaatagaaaaagcagaaagcccattggctccattcttggcaagactccattgctgctgtacaatctgccatacaatcatctgcaggtcatatggcagcgtttcctgttcatcttctgttgcatccttcggaagcacatatcccgctgtatagattactgttaaatacctgctgccgaggcggatatcatccgccaggccctgccgatatcccttgattgcccagccttgattccgaaaaagtacgccatactcaccgcatccggaatggtcgaaatcggttatctggttaccatcatccccaattaccgattctatttggattatggggtactgatttaggcatagctcctggtacccagaagcaaaatgtttctctacatatttttgcttccggaatttgcgcccggtaacagcctcaatataggaggatgctgcattaatcagcctggtaatattgttttttacggtatccggagctgtttccgcatccattcccataaactccagcatatcatccaatgtagttaatgcattttccctaagctgttttacagacattttgcatccccctatcgcattacttattctctccaggtcccttctgcatctttgtttcagcaggcttttttgtatcgcctgtgggttttgttttctttttctccggagtcgattccggcttcgggacttcatagcgtcttatcatacagcctccttaaaccggtgcctgcgccggatctcccaatactactgcatatacaacggtagcttccgtggtcggcgtaattttaatgtactgtttgcaccccaggagatcgatatccacattgagcatatcccctgtctttactgctgcctcacgcaacggaccatcaatgccaatatggtcatcatctactgcgacaaactccccatcctgtgtatcacaatgggttacggaaaatgcaaccttctgaccatccgctgccgtagtcactgatgctgccacaatggcagaaagaaagccgctgcggtcaattgcaacggctgtacctccgggaataagcttcacgttattatataattctcttttcatacgttcctccttacattactttgattttattggcaacgataaacgattctccgtgccttacagcaatatcgtcatacattgtagctctggtcgctgccaggttttcctcaaatgcattatgggtagttccttcgtcatccacccagctgccttccagggttgtaaaagtttccatacccatctgatcaccaatcagcatgtctgcccagtttccaaaaaacagttctgtcagtccggtggaagataccggaatctggttggatactttatagggtgctcccaggagctttcctgcctgcatctcatccctgtaaatgtaggtacctgtgtcggttttcatattcatcaggaagccctcaagcatgctgttaaatgcccatccaagccgctgatcatcaacgttcttctgcataacaacagaacgcagatatacagggaaatccgctgtaataacccctgtcgtagaggcgtacatggcatccaacttggttacatcgattttttctacctctttattgtaataaattcccaagggcataaattcaccgccggttccatacaggccgccataatcaagacccaactgcattcgacgagtcagatcattggcgaaaatagcatctgcagaataactggtactcatcagcagttctctggactgcggtacaatagcagcgaggctctttgcagacagtttaatatttccaaattccggtgcggttttggtaatctttcgctgttcccctctccatgtagccctggtgcccgccgtcatttttggaatgttgagattacccttgtccagcggcactttctgggcgcctaattcgaaaatgacagttttgggatataacagctcaataatatcatccatgtatacttccggaataagatacccgccataggtaggaccggtagcagaaagagctttaaactctcccgccatctcggaatcaccataatttttctgggcgaaataggcagcacgttccggatcctgtcttccccaaatgtcaatgcacttaatggatctcgccagcattacatctgcaggtacggctttcttctttctgccagttgcttcttccggctttgccaggaaaatattgctgtattttctctgtacggtttttttctgtatggttttcttctgcatggacctgcttttcctttccctgccagctgaagagctgcttcctttttcttcttcctccggttcagactctcccattacctcagctactgcatccagaatatctgttacgtctgcatcgttaatctcatcggcctttgctgattttcttttttcattcaccgcgtttatagcctcttccaggacttctccgacatcaatggtattttcatcggcttttccctcttcgctttctgtgacggcattcaggaggtctacagcgtcctcctcagagattccttctccttccttgcggcttttattaaccgagtcaatggcagcctcaataatatccgccgcattctccatgcctgcttcttccccctcttctcccttacagtcttcttccgacatagcttccttcaatgctgcctttacgatttcctgcaggtcagtaacgcttgttttcattgcttttgtctgggtatttctgtttacatacttcttttttctcattctaatctccttttaaaaataaatttctacttccctcaccgagatgcttttggattctttcccgggatttacctttttggctccttccacctcccggataacggcgtcaatgatgctggatgcttttttcatagccttgcttgcatcctgaagggatttcaggcgcatattgcttatcttacgtcctgccttcatatctttggccagttcctgctctatttccaaggcgcgctccgcagcctcctgcatagacttgtagccagtaatttttgcctcagggttcatcgcccatgtgacaactgatacctcccagagttttatttcccgtaaatgccggattccctctgcgtcataatcaaatacgacaggatcatatccgatagacaactcattaagtacgccatccttcaggaggactttgatatcctttcccatggatgtatcagacaccttagccgacaggtataggccgttggcatcttcccgtagctcaattgggcgcccaataggcagccagcaatcattatgcagggctaatatcttgactcgttcccatccttcggccagtgtcttggtgaaggccccaggttcgatgatatccccgccggtatctacatttgaaaagacagctccataccctgagaatattccttcctcttcgttgtagctgtctaacttaaactgcatctttttgtattcatgattttgcatttttaattgatcaccacctttcttattcaatttatgaatacgtgaggaagcaatggcaattcactgtttcctcagcttttccgcattctggatcacatggcatcattaatttatttccatcaagggttacgaatggctcatcaatacgtaccgttttcccatttaggtcccgatgagtatcccttgccttagccggatctgttatatgccaagtcttatattggaatccaccggttttggccatgtcaaaatttcctgccagcagactggtattacattcctgggctgcaatcagccgtgcccgctcatctgacgtattcattgccagaacaatctcatccgtaagcgtctgtttattttttccttcctgcaatcctttagtaatgatatcttttacggtatccttggtggtctgtgtgactctggtaattctttgtccgcctttcaagcgggctgtggaaacaagcgccggctgctgtattccattgagcctatacaacgtctgtgcctgttctgcgcccttactgtatgtttctgaccatagcggcgccagaatcttttccagtagttcctcctcctttccccaatcaagcagctgatctgcaaattgtgcagcaagctgttcctgttgcaccggtgcaagtgcttcaaattcttcctgcgtcatatgcagcatttcccagatatcgcctgctgccttccgggttcctagaagggaagaacgtatctggctggattgattcctcaaatacttaaacatagcaagctcaaatttcctgctctgttcccgttttaccgcctccaggcttctggctgcagtctgcaccctcctggcttttatttccattgccttatgcaatataatttcttcgtcgtccataccttcgtcaggaaccagttctatgctgtccctatcttcttctaaaggcggtgtcccttctgtatactgcatattggctacgtggctgctgatttccaccaaatcttctttggcatcaacaaacatatctgcaaaattaattttatagatatttccgttatcgtctgtttcaaggtttagcagctccttggcttcatttctggttacaagtccattcgcccatccttccattgcgaccgccttgtcccgttcctcgttttttggaataatatcatcatattcccatatcaggtcatcaccataatacgggagcagctgcagattaatcgcatcctgacgttgcataaggcgaggccacaatacatttctggcatagatatactgtgctgcatctgccgtggccctgttgctgttctgtgtaatgcccataatttctctgggcattccaaaatgttccatgatcgcatcacgggtaaaggtccggccatttatcatgtccatatctttcatgttgtcagccagtttggttattatcggcgtcgattccttaggtccggtaagtactgctacgccatgggatttcatgaacccccggaatttctcattccattcgctgcggaagcgttttacctgatcttcatttccaccaggaataacaattgctgtatccggtgttgctccgttccaaaagaaatttttttggaattttgccgcatactcatccaactcagcttcatctgcaacggcctccgcctgtcccaggcctcttcgatatggatctaccgggtttagatccttcatcgtaaacatatcctccatggatacattcacaatcattccaccagtcgtccgaacaacatagtatggagctcccaaatatggggtttgctgtacccattgtacgggaactggccataactccgccggcatcccatccgggtaccgttcgataagtaaatatccctcccccttcaggagtaaatattcctgaaaaagtttccatatcgcactcgctgtaaactcaacaagtgggttaggtcgttccataaaacttagaaatggatgtttcgtaatttctgtacgattcccatcattgtcagtcctatacaactttccggttacataagataaatctcctgctatcttctctacaggtgccaaacgtgggttttttccgaatgcctccatccattcgctggtattacgcgccggcggtgatgtaaatctcggaatcatagccgaattattatttgtaaagctatccgctctgctggttctgcgtctattaaataatcccaccttttcacctcccttaaatatataaattccatccctgaggttcatacagtgcaagtgccagcgcatctgcaatatccggtgaagggagtcctcgttttttcatggcttccttccgttccagttccagacggccatctttattgactgtatatttgcggctgctcagttgacttatcagggtgtcattatttggtatctgcaatgtgccgtccatcagggcctgcctcactgctccccacattataccggtgctattgctgtactcaatgggatcctcttccctgacctttcctccggcgcctccgaaatggcactccattatttccaggtctatcttaggaatatccaggcattccaaataatcgctatgctcttccggattcaatcccgcccgagtgcatctgtccatccatatctcttccacaatctgctccctcatatcatacagattgtcatatacgccgactccaaggccgtcacagtctacttttatccggtatatcttcatatctggatacagattcgcatatttcttgatcatctgtactgcatatccagaaatctccgttgtgcggttatgatgatatatttccggttcttctgatcggcgctgatcaaaaagaggatagagtgcggaactgtcatctccataacgtgcgacgtcaattcctatgtctatcctttcatttttcgttttaatttccagttctgctgctgcctcacaccattccatggcgatcaggctgtctgcttccgctttaggaaactcaccggctacacggatacggaatacgtcgctgtcggcgccgaacatatctataatcttatccacaaaagcctgatctacccgtgcacatgttcttccatcaatgtgcatcgcattgtatgccgcccggtttttatggtggctatcataaaagaatccggtcagtctggtcggattcccacacattaacagttttgctcctttagtagataaagcgcctaatacgggttcaaacacaatgtcctttacccctgacgcctcgtcaatgatgaataatacatgctccgcatggaatccctgcagagcatctgggttcgttgctgttcttgccacggcaaaccattcctcaggatgtccgcgcatgtatatcttttctttggtccatataagctccctggccagcgccggggtattgcgtatccacttagaagcttctgcccacagaatatcaaatagttggtgctgtgtcggcgctgtacatggtatcttaggatatggccgggtacacagataccagagtattgcccagctttccactgcactttttcctattccatgtcctgaacgtacagaagtcatgggctctgcatccaaactccgcaatatagctttctgattatcatcaggctttacccgaatgacatcttctacaaaatccacaggagcatggtaataatattgtattgcctctttaagtttgctcatctctttctttataagcctcctcaataatatctcccaggctactgctttcttctatcttaacctgctgccgttttacagcattgtctaatctcatgccctgtatccgttcttcctgttcctgctcatccagatccgtctgcggcttctccgtccaaccgcggaaattattaattaaactgaagcgcgccccattacttccatccttgtcaaacagccgctcttccgcatacgcctctaccattgatttcgcgcgcgtgatcgtgttcataaattccttttttccttgataattcagcaaagataatcttgtgctgaatcctaatgccagcgctaatccagtaaccgttggtggccttgcgcctactataactggatttccaaatttatcaaaaataacctctccctcttcatcttttaaaatttcaccttcacatttcttgaaatattcttcaattagaccttcgatttcttctttgtgttcatattttggaggccttccgacctggccttttgtcatccgcctcaccttccattcatgaatatttgacttctctttacccacataaaaacacctggccgctgctgcagtcaggtgtttccaggttggagtgctgatatgtgggaggaggaaatcttttttctggattccctagctttgattatatcacacttttttatcagttttatcggactttaaataatttgtaattttttccgaaatggaagcctggcttaagtgtaccattcttccaactttattttgggataatccatcaatataacacaatctgaaaattctacgtgtaatactatcgggaatttcttcaatccaaaattccacttctaaacagtcggtctccagttgatcaagacgggatttccacttttttttcaaataccgctctttttgataatcataaccgataacagattgtggtcttggatacccttttttgtaatccagtatcgtatcatttccaattaagctatcaccatctcctacatgttccagtttatggcgtaattctaaagtctcagcttttttgcttttataatcttctaatctttcttttgttatctccactggattatcctcctccaatcttttatgcctgctgcctgcggaattactttacataaaacaggtcaagtactttatatgatttcttctaaaacgtcaagttttttatatattttctttatatcagaatttacaggaattgaaggagggcctcatgaaaatagcaaccaaaacagttactgtcaccacaggtaatagcggaaatacatatcaaaatgaaatcgacctgaatgatatgggacttgatgtcagcaaaattgtggcgtgctattttgaaccttcgaatgcacagctacggctcggcagtaccgccgggggaatatgtactatagccaaagattataatacagcaaccggaaaattattattaagtattggtactacacagcattgcttggctatgacatggaccggtactgttattgccataaccgcttaagccgcattaccgtgcgtaaataatggtattggagcctgtataattggtgccgccactgtagcaggccgccagctggcaggagctgagggatacattccaggcacactgcgccccgactccggaggtgtacccgccgttgcaaaattgcagcgcagttgagataagggatgctacagggatgatagcggtatatgcaagcgtcatattcccagcacaccgggttatcaggtagatttcctgatactggctgaaatctatgtttttcgtagcggtgccggttaagtctccgatttttttccactgtaaatttcagtttaactcagcattatgaattttttctttaagtgttgtcttccacgaaagcatagcatttacactaacattaaccagcgtttctaaattactgttcaggccaacttcgtcagctattcgttctctggcttctggggaaagtaggcagaatttctgtaaattcttcacttcattatcaatatgttcaatctgtctcatggcatctaatactttcactttatacctcctttaaatcctcatttagtgactgtaactccgaacgaaatctttgctattcatagccactaaatcgcgcaatgtattccttgctttctccaattcctgcaagtgttgctctattgggtttttttcatatactttctgtttttccctaaatctttccacgaagcaccagtaaccgtctattttcccataatgtccacagactttcacattcccttcctttccgctgctttttgcttttaccggccacaccaattgtccgcctccattgcacggctatccccgcagcccaaaccggttccctgtaaatgctcatttatgtacaatcggcaggaattgaaacgtccacgcctcatccataatagacaccagattcccgtcctcattgattgccagcacttcaattacctttggtttgacgatagtatccctattttcccagtcaatttcgtctggaatccgcacttccatgagcgcaacggcatttaatatcttatctccgtgtactaccttaaacctgctcaaatcaattcccataattctcctttccagactattgatcaaaatcctcaattaatcaattaatcccaaagtgattaatgccacaattccaaataaaaatgagatcaaaaccgttcttgctgattcagcgggattcatgcccgccgaatacatcagcattaaagacaacatcagttccataacgcttaaaaatttagaaaatcttttatttttcaattattacgcctccgtttaccatccaactatacagtgtccaggcataagcccatatgctggcgcatcacgcaacacatatttgacataacgccgtacgctttcacctgtatagaatccatcccattcttccaggatcagcagatcgcctacctgtatatcatcctcgtcaattctgatttcaaaatttttttcccgcgctcttaccggtttaaaaaattcaggatgaatcttttttctgactatcttcactttttcctccttatggctaaaatccaatcttatatggaccgttccaaatcatataaccctcagatattggattcctttcgatttcttcatcgtccattgtagctgatttattatttgcctcctcctccgaatcagcgtcaaaaatcactttgcgaaaacaggcatattcaacctcgtatttcatctttatctcctattcatatttagacctgctgcctctggctgttttcagaatcccaatatatgcgatgcatacatatctgctgtgtgggtccataatacattgggatatttcttgattgcagttcccagattgttccacatttcactgccttcataggctcccatatgataccggatacatattaactcttcatcagttaatcgcatttccttcagcaggagaattgcggatttatctccatgtccccttaaaagtgtctctccattgtacacatactctccctgctcattttgagtgtattgatctaccttacagtaatcatgaaggaatcctatgatatacggagactccggcctatcccattttaatcccatgcgttcagtcatgcttgccagtactaatgccaccatctcggaatgatcatacaatccacccggaaaattcccatgatgatttgccgatgctggagcctcgaaataatcatcctgcagcatcctccagtacattccatcaggaatactatttctggcaatatttctaaatgcttttattctatctgcctttgttctcatttctctcctttcagactgcggccacataggaccggaaaatattgattatataatcatcgctcttgtaggtataatactggttcgccgtgttctgctcgacatgccccaggtagtctcctgccttctcactatcccctccgcgcttaattatatttgtggcagttgttttgcgtatcaaatgcgggtacacattgacttccatctttgcccttgctgcaatattcttgaccgcgctgtatattcctgtgcgcttaagcgcatcatgtgttccccgggcaataaataacggctcccggctactctgattgatacctctttcctgaaggtacttaatcaaatattcttttgccactctgtcaatgcagactaaacggtatctgtccgttttatgtccaaaaatcacaatcttgccgtcgtaccagtccacgtcacagactctgacctccggcacctcgccgtcacgcattgctgtgcatcttaaaaactccaataaagccctatccctagtactattgcatccggtcttaagctgctcccactgctccggttcaagatgctctatcggcttccttgtctccttatatcgatcaatattttcacaaggattttccgtgatgatttttgatttccgcatccaagtgaagaaagcagaaataaatcgtttgcagttgttgactgttcggctggtatttcccttctttttatatttcatcaggaaatactcaacatcattttccgtaatctgcgtcaacggcttatggattacatcaatcaacaaattaatgtgcctcagatattgttcagcggtccgttctgacagtttcggtgccttcttggtattaaataagtctataatatattcgtttgtcatgtcctgtgttgccagagccgtctgctcctcgacaacctcaactccatacattgcttgtatcaacacatcctgaaggatcgtcataacctgtgctgtaagatgcacgcgcattgctattaggacatcgttgactacctgctcttttcttgtcatttctgcctcccgtcttgcttaagaggtatcaaaatgatataatactcttaagccagtaagcggtgggtatcatcttggccggtgtcccaccgctattttttgtccgatttcttccattttttggaaatagatattgactccgcgcgctcagagtgttaatctatatatgtgtttcgaacatgagttctgttctttgggaggccgcccggggacagagctctttttctatttttcttcaaaaacaaaccggtacccaggaacacgtatcgctcgcggtgttccaaattctccatcggtttctatcattccgctgtccatcatctttttaatgtgattgctgacactactttttgatttcagtccgacagcttctccaatctctttgaaagaagggctatacccatgttctttcatgtattgaacgataaatctcctgatttccgtccttgttttttctccattttccacactacatcctccaataaatgctattcctaaacgaatccggcgccggtggctgcgcacatccagatagcattgtcaccaatataaaaattacaattatcttatatgcaatcttcaccttttacctccaagaatgagaatccatcatgttctccctgtgtactcctgctgccttttaaagtttctaaaacctgacaattcccatacttactatatgttactgcctccctggaccatcctgggtatatgtcctgcatgtagtcctcaagcatagcctgcatttctccccgcaggcctttattcccattatccatcaagctatggtgaccgatgcatcccaggactccattctgctctacccccaggcccatctgggaccgggggactacatgcataatctgcaggccgccataccggcaggcgttctccatatgatatccccgccggcagaagaaacaggattcctgatcccttttatgtatcgctttcctggccttcgctgtaaattccgtctgcctcgccattcggctcttcttcggcttcttccttgatatcttcatcctgtttcctttctatatcctctatattcagctgacccggcagctgagcttctggtgtcgggagaatatcaaattggattacacagtatcccggcgcaatcccgccgtgatcatctgtcatgtgcgtgactaagatatccgttccttccccggtttcttccccgttattctgctctctcaggtgcagcgtatttccaattcggtatggatcatgcattttcagaattaaatatctctgcccggctttgatatccttgagcatcgtttttcccataggaagtgtatattctgcatctgccggcggcagctctatggacttatactcttttttctccggctccttccaggaaattccatctcccttgccttttccctgcggtaacctttccggtcctatttcctccggtacgcctgctgcctccttacttttctcttctgcttcaggttctcctgcttttttcttcttgcctgtttccgtatttttctttggttctgttttcagtactcttccaggtttctttttcggttgcaccggtgcaatttcctcattttcaggaaaagcttctctgtaaacatgttcccagccttcttccggtgtatcacctgtcatcaactgactatatgcttccataatatcttcccaggtatatatttctttttcatctgcccggacattaatcagtgtaatatcctgatctgctcctttgaatgaaattattatatttcctattccctggagtcttacggtacacatccctgaaccggccggagctacagcatccatggttgctcttgcacaagctatgtcgctgtctgtatttatgtacgcgttccataattttttgtacaataaaggcatgttttttcctaattgatggatactgcgctgcaggttattttccagttgctcctggatttcattctttccttccatcaggatttcaagatctgaaatctgtttttcttcggttatttcatctcctatttccttgatctctgctttgctataatctttcgtcaattcatcattaagtatttccgggaacttaagcataatagccagcttcgctctgccgtatcccctatactgttcctgcaggcggggagaatatccattttccgcaaacctgtcattgatattaataaatctcgatactgcggagctatcaaggccatattcagcctgtgcaaactcattaatatttttatatccggattctttcaggatatctgtatcctttgctattttcagcagatatcccagccgtacaaatccttcctcaattctttcaacttccctgtctacagattccttgaattccgcataactactatatcccgcggtctgattatccatcctgattatttctcccattacactgcctccataaagtcttccagtagcccctgcaggactctggtattatttttccgtttcagttcttccaggttctcttcccgttttactttgctgattttggcaagttccttctcctgctgtgtcagccgctgtttgattattttctgccattccctcaggaatccccgtatttgttcaatccctgtttcctcatccagataggtacggtgctgccggatggttcctcccggctccacctccagtgtatagtatggagtgtcaggttccgacgcccgccgcaggaagaatatgtatgtctcccggctctgtatcctgtcataatacctgtctgttgcccccgcacaatgatgcagcgcctgcccctccagcatgatatccgtcaatttttccggaacgattaccttataggtttcattctgatattcatagattccttttacctcccgaagattcttttcagcgtctgggaacttctccttcagttccctttctctctgctctgccagttccttatttctccggatatcctcaattatctgctgctttcggatttcctccatgatttcatcatgccggcgttttaattccctgggacgtgttaccaaatcatccgtcatatcctttttcatcttcacgcagccggctaaatagtctatccactgctctaatacagccttcattttcagattcggataagattctgcctgctgccggatgaggtaatgcctgattttttcaactgatacggggatcccgcttatattctgcggatctatattactgtctatcagccatttcaacgtttctttcgaaagtttctccccggtctggtccgcccactgcatccagactaacatggcctcaccgccgtcctgttcccggatacggtgtatcttttgcatgtcatcaattccgaatacttcccggatatccttcccttcaggaagaagcggtccatagtatctactgcctccaatatgctcactgctttcttttagcagtttccagtacctgcctttcaataggtattccgtcatctggcttattccctctcccggccatatccacattaatttgttataatttgcctctgcgcctgctgccgccatttgctcgaatattcttatccatggctcatacagggtattgtccagtgcttcactgattcctgaaggatatagataaccactgacgcttctgcggtttccagggttccctttgtcaaactcatcggtacaggcgccatatatactgatcctgcagtactggttataatagatctcgcagcttcttctgattccatgatcagatattgttgcgccatctttcaggggcatcacccgcattgcctctgatgtctcaatactttcctttcccggctgccagataattactgcgtcatagtacctgcatacactctttttatcatttaccggctgcatcagaactgccccggttttctttgtcaccttttttgtacgctttttaaggataatttcatttccgcacccccggcaggtaagcgtccccacggtattctcgtctttcctgttcgcagtcccgcaacaagaacaaacatactccttcttttttgccacatagaatccgtaatgttcctttgctgcggcctcaagtattttttcttcaaaatcttccggctcctgcgggatgcttctcatcagctgttctatcctctcccgcctgcgttcttctttcctttcccgcttttcgtaggtgtagttatattccaggttttctatatcctggagcgttccaccatatcttgttaatggctttaaatttaactcaataatttcatgggcttcttttggctcccatatccattttttatccacctctgagatatagcagccccagcgatcatggcctgatgctatcacacttgccttttcttggagccacacattttcttccggattgtaacactcatactcgtgtgtctgcgtgttcatgcaataccgtgtttccagtattttgtcccgaaaaaaattaaggaccagaatatcatttaccagctgtaccgtaattactttcccttttttactcggtaacagcggcggtgtcagcataactgtttttcttttcatgctcccacattcctccttcgttcaggcggtaccatatgtccggctgaatatcttctcccacaattcctactttggcggccagaaagaaaccgtctttttcctttaaaattccgactgctgccccccttttcccacgtacccgaggattttctccgcgagctatagctatcgcacctttcccggccccttccgcttccatatatttcacttccagcaggtgtccattccgtgtccagtccctttccggatgctgcagcatgtatgccatggcggcgctacacaactgcttcaagttcagttcccgtacaattcgcatttgtgtgcaggaaatcttgctgtccactccatcctcatccaggcttcccatggcctctacaaggcaatatcggttgtttccccccagaggatagtaacccaggcagtccagaggattttcagcgcagtgcagacctgtcctcgcgcacttagaacttgtctcacataccgtctcgcctatggtatactgatactttccacgtcccaaggtgcaggtcatgtctgaattaaatcctttatatgcaatcatttcagccctccaggtaatattctgtaatcagctgcttcacccgggccattcccggaatacccaaggttgtcctcggatgcgcgcctgctgccttgataatatccggcgccacaggcttggcatttttcatgctccacaccaatatttttgctatacatccctgcaggcttttcccttttttccgcacggctgctgccatatctggttcttccgtacaccgcatctggatgtatgtaagccagtcctgcataatctcatacggctgcagttccgtttcttccactttaagttttcccattgctgccatcatcggcgtacacagggccggcgccatgccgtcaatataatcctgcgcgtcctcttcgtcgattccgttttctttggcgataagaagtattgcctccttatctccctccgccagctgggcggccgctgccaggttaatctcttcagcgctatcaaattctccaaatttctcccacatgattcttcctcctgttatagtattttttgatttaaaaatcccatctgcatcagctctgcattggtcactcctctgcggattccaaaagcgtttttcaacagacaccagtggtcataatgatgcagtacgcagtattctcgcattattttcttttgcttgccttctccatctcccatataatcaatgtccggaagatgtatcatagagccgggctttatcttttctttacttaacatttttcctttccctccacactcaattcaacgatcatccactctctgtatgagtggtcatcctcggttatggtatacacatgaggctccatggcctctaagagctgctcccacaagtctacattgcttacaggcttccctttggcattcttccatccattggtcttccattgtcttggccaatggttttgaagagaatggagtacatggccgcatctggtatatatccgcaggcacgccggcctattaatacgccccacagcctctaccaaggccgccaatgccaagcggttttccgtggttgcttcttgcctccctcttcccgccctggtcaccggtacgccggcggcaatatactcaagcacgtatatgtactctccatcctggatcttaggcccttttatggatgtctctatgtacagatttacctgcggcctgtcctccacttcttttccctcctttcttcccgccatcttgcagaggcaataacgaataggaacgatatctatatccggtatatggatttattccctcctttaccgatgacttgtccaaataataccccgccggtaccttaatctctttccaggtcttccaatgccggtatatcttcttctctggctccggtatgggaaggttccgggaagcggagtagtcgctttccctcagccgcggatctgttgcaggtgttttggtgatataggctgccaggtctgcaaatcctcccttctcatacatgagggtattaattacctttccatacggccatgccgcctgtaagataatatccgtatcgggtatgcggttgatgatcacatggatatgccatccgttttttgttccaacttccacattgcgtatccatttcagttcatatccccgcttcctgtattccttgcgcacctggcggatgcattttgagaactgttccttggcggcctccatatccggaggccgggcatccttcctgtatgtcagatctgaaaaataatcctcttcctggaagtgctcccgcaatttcctcctggccttcttttcccggttcgtctggttctgcttttccatctgctctggagtcagtttcttcttgggcctccgttcctgccccggagctccatactttgctgaatggtattcttctacctctatgcccttcttgagcctatatattttttttgtaaatgccatatcccccggtcctatctttaatttctttatcaagttttaaatgcggattttaaccgcatttttcttgattttttctgggccggagcgtataataaatttgtaggaatttataggcttcggccctggtgcatggctcccaaccatgcaccttttttattgcttgtattttctgttttctgaggtctgatttttcttaatgcattccaagtacgccctctgtacatactcttctgggaatagtccctgaatgggcttgtccggtacttcacgggagccaaacagttctattagttcctgctctgatagttccatgaacagtgccactgtcctggccgtatcatagcagtactttgccttcccccattccttttgtctgacataattatggaatgaagcagaaagctcccataacttattcttcacagtcttcatattctgtatcatcagacatgccctctacatggtagtggaagcgcagattcctttcctcagcggcccgcatgtatctcttacagcctgttcccttccagcgctcctccacctcttccaattttttttgatattcttcaatcgtcatagacggcttcagataagcagcatccagtttccgaatgacattctcctctatctcgcgctcccaggcataccctccatagttgtatgggctgggaaaatgaattttttcctgaatgaacaggaactcttccactgtcaaatccagcgttatggttgcttcctttgtctttttctgctcttccatagtttcttctctattcttttgaaaaataatgatcacccactttcctccagggtgtcccatagttgccgtattttcctgcagtaaaatagtatattgacggatacgatctctcctgcagttccattcgtaccgccaggtacgtctcttctgatggttctactactctgtctactccaccatcccaatatgaactaaactggttcggttccaggattacctccgcgatgctattcggccaatccggatgatctacgcggttaagaaccacatctactaccatgcgctttcctatcagcccctggtttcccgcttccgcctccgtcaatatggccagcagctccagattgtcatagtacttctcacattccagttcttcttgtgtcatgctgctctcttcctctgtcaaagcgtcctccggcattgccgcctcaatgcggcctccccagaggaaccagaatataatggctgccaacatcgatagcacggcatatgacatgagctgaagcatcttgatcagcattctctttttcattggcttgtcctccttatcccggcttacgccggttcttttcctttgtctaatacagtcactgtgagttcacagcccagctggtcctccagtaactggatgagtcgttccttgattttgttcgccctttcgggcgtaacttccatgtcatagtcatattcaggattcatttgtgtacgcccctttcttcttttactaaaacctatgttttctcggattgtcctcattacactaatgttgaagagtctcaagaagatcatcagcaaaatcctgaacatttttcaggtggagattttgattctcaatcgacagctccaactctctttgaatctcagtcagagaatcccatatctcacggtgcgcctgacgttcctgatacgcattgatcatctgtcctactactaagaccgctattgttatctgaaccataacaatatgcggtttttcatcttttgactctttcaatgtttatacctccttgctttttactcttctgttccttgatttcaattgttttcctctctataatgtaggtacaggctcctgccagagccgagtacatagaaaggagcaattattatgcaaattaaccccgaatgtgtaaaagacattctatctgtgtttgaaagtgtagttaccaagtcaggtactacttacactatatcttcttggtatgaacttatggatttcgatcctctacgcaagtatagtgttgatgaaatcagttatcactgccaacaaatttatttgtctgactatctttataacggaaagatgctagcccaaggtggaatttcttttatggatataactcctaatgctcatgcctttttggctaacatgcgtattcccacagtttctaaaactattcagaagtttattaccttggtaggtagtgccagcttacaacaaatagcttctatagctagtgaagcagctctcaattaccttcctcagcttctaaagtaggaactgcacaattctcatagattggggcaagcgcatcttgctttacatcaagttcccaaccaccttgccccaaaatcaatctgaaatctgtgacattttttagttcaatgctttgtccattaatcagaaaatctccggtaaccaaattgagatatatcgatttaagctgaaatgatttaattcccatcttattttgcctccttcctactgtgctccggttttaatgtcatacctcctgaagctctctcttctcatccggtttcgtttctgcctgctgccttaaatctgattgagcaggaaccattcccagaatcataccgaaaacaatcgcctgctgacgctcattgagcataggagccattatctggatattctcaatggtattccccgttaatttgatatcttcttttttcacttatttcacctcctgtcgagttaaacctaattttctcgtccttgtctttctatatatttctccctataatgtaggtacaggctcctgccagagctgagtttaaagaaaggagaatatttatgtttgattctaatcatcctgtggttgaagcactaagggagctccaagccgttagccgacttttggaaaccaatcctcacatagctgataagtatggaattatatattccggtgaaaaacagaacattatttcctcaaaagatttatttcacactttaaatgggtattttaaaatacaaattacatatgatgaattattaggtatgctcccagaaatctgtcgttattcaacaatgcaaatagaaccacctgataattcacccatcttttttatcaccctttggtaaatcatcaacggggccaattccgtatggaagaggctccgtcatgtatttacgctcccatccataatatgcatgctgaaatatgcatttctccaacaattcgactccttcctccaccgtcatttctctaatcatcgaaagaatcttttctcctttctctttttgcaaaatattgaaattcaatactctacaaactttttctatttctttcattccatccattctattatatctacctccttgttttctttgtctctagtatacgagtctttcaaaacattgtcaacagttttttgttgactttgaaaacatagtgaagtataatccgattagaaaggtggtgagacaatgagtattggtgaaaggcttcattatttaagagaaaatgaattagacataagccaggaagagtttggaaacagaataggtgtcagccgtttttctatatcaaattatgaatctggaaaacgaagtttgacttctagggtaattgcagatatttgccgagaattcaatgttaatgaagtatggctccgcactggagaaggcggaactgataatatgtttacaaatcttgatccagcggatcggttcacaattagcttgggagctttatcctcctcggaaaatcaatttgtccaaaatgctgtaaactatctagcagaggtcggaccggataaattaaaaattcttgaagaatttatgaaaagttgtttagggataaaataaaagaagctcccttaatggaagcttcctattatggttactatgaatagataaatacgccgtaatatttttatttctttaattgcattcaccatttcattaatttgtattttgtattcgtcttccgtcatatgtagccctcccgttccatccgtacatttgttcgattttagtgggtgacttaataataactcttttatcattctctttcaagcccaattcgaacatttgtttgtttttagtcaattaccaacattaggtaatcgccttacaacttaattatagtatatttttcataatattgttttccaaattatggcaatatgtctgaattaagttccttagtttactatttaatatgcaatttatgtattttcactaaattaagaatttttcttccttattcagtccgtgaaaggattgtttttgtccttcaactgcatttgttattttttatttttgttacttttatccaaagtaaagaaaggaagtgttttatgccattgccaagcgaacgcaggtatacctccgcggattactggagcctaccagagggccaacgtgctgagctgattgacggccaactatataatatggcgccgcccagcaggatacaccagaaattgatttctcaattcactctcattttgggagagtacatccggagtaatcatggttcctgcgaagtataccctgctccttttgctgtcaatctggattccgaagaccaaaattgggtggaaccggatgtctcagttatttgcgataaagagaaactcaccgacagaggctgtactggtgctcctgatctgattattgagatcgtatctccaagcagccggcggatggattatggaacaaaaatggctctctattccgacgcaggtgtccgtgaatattggattgtagacccggaaaaagaacggactacaatataccattttgaagaggatgcagctcctacaattgttcccttcgttcagacggccggcgttggaattttcaagaagctgcagataaagctttctgacctacttatataagttgcaccggtgcaatttcatagtggccgccctgactccagtcggggcggctctaaaataaattgcatttatatcccaccagaataataattatatataggtgataacatgaaagaaaaaataatacgttgcgcaatctatgaccgtgtatcaacggacgggcaggtcaaagagggtctgtctcttgatgcacagcaagaagccctcacagagtatgccttatctcatcattataagatcgtggattattacgctgatgagggcattacagcccgcaagaagatgcagaaccggaaagacctaatccggctgctgaatgatgtcaaggccgacaagatagatcttattcttgtcaccaaactggaccgctggttccggaatgtgaaagattaccataacacgcaagctattctggagtcgcataattgcaattggaagacgatcttcgaagaatacgatacgtctacctcaaatggccgttttgcaatcaatattatgttgtcggtcaacgagaatgaatgtgaccgagactctgacaggattaaaaatgtttttgactataagaaaaaacaaagagagcatctgaacgggaagccggcttatggatatatctcagttaagaaaaagcttgtcaaggatcctgaaacaagacatatagttgaggaaacctttaatcattattttggctgctattccaaaaacgccacaatcaagtatattttaggcaaatatgcaaatgagcagaatcctccaacaatgtaccaagttaaacggattctgacttgtgagacatatgctggccgaaaatacggaattgataattactgtgaggcttacataacctgggaacaatacaaaaaaatcgtttccacctctgatgctaaaatcattcctcatcagacagaacccttccttttttcctcgatgattaagtgtccaatctgcggaaaaaatatgtcgggtttcgtgaagcgtcaaaaattaaaaaatggttctgtcagcgaatataaaagataccggtgtggagcaaagtttaccgaatatcataacggggcctgtatatcagaatcagttatagaggcctacctgctggataatgtgatgggcgagcttgatcgggagctgcttcagatcaagtcaaaagagcaagaagaaaaacaaaagaagcctgctgccaatcctgtaaaaattatgggtgagataaaccggttgaacctgatgtatcagaaaggccgcatagatgatgaatactacgacaagcagtattctattctgaatgagaaactctctgccgcccaacagccgcatgagcacagaaccatagaaagctatacagctattagagagactttaaatgatgggtggtatgaaatgtataaaagacttgatattacccataaaaaggctttttggaagggcattatcaaggaaatttatgtggataaagacagccgccagatatgcggttttatatttatgttatagggtgtagtaacgcatattactgcgtagaatttgaaccacatgccaccgccctggaagccaaaggcgacggttacgtggtagcatctctgggcgaggattccggatatgtcccttacaccgctttttccgcgaaaaagggctatattgaggcgcatcccgacgtaatccagtccttcaccaacgccctccagaagggtatggattatgtaaagagccacactcctgaagaaattgcagcagccatccagccgcagtttgaagaaaccgacaaggaaaccatcaccaccatcgtcaccagatattatgatcaggatacctggaaggacaatctggtttttgatgaggacgccttcaccctgctgcagaatatcctggaggaatccggcgagctttcccagagggttccctataccgacctggtaaatacggaatatgctcagacggcagcaaaataactgtctccccggcgctttacaaaaaatcagtagaggcctccgctttctccccaacaataaaccgcaaagctttctcttgaaataaaaaaaccggcagccgcagacataatctgcaggctgccggctctgtttcagccgcttccctgccctgtttcagcctctttcctgtcctcacaagccgcttcccttcaaaagcaacgcgcccgctttccacgccgctgtccgatttcccttccactgtctgccgtcccccctcagtgatggtaaaaccggaccgtaaagcaggctcctccctccggcaggttctgcgccgtaaggaaaccattctgcatctcaatcagggatttcgccagggacaggccgatgccgatcccgttttctcccgcatcctttccccggtaaaaccgttcaaacacatgcggaagctcctccggagcaaaacccgcccccgtatcctggattataatctgggtatataacggattacaggtataatccattatgatccggccgccctcaggcgtatgctccgcgcagttttttatcagattggaaaaagcctccatgctccattccatatccccctgaaacgtaatatcgggatggttggggatatccacccggattttccgtgcgcggattatctcatccacgccctccgccgaaagctccagcagggtaaaaatatccacttcctttttttccagctgcagcacgcccgcatcaattctggacagggtcagcagcgcttcaatcagccgttccagccgcgccgtctgttttctcagcgaaaccgcccgctctcccccctgtccgtccgtttccatcagctgcgccacaatggaaagggaagctaccggcgttttcagctggtgcgctatattcgccagattatccgcaaaattcttccgctcctgcaccgccgcttccctggccaaacgcagggcggtcaccgttttgtatatctcatcctgcagcggggccagcatatcctctgcgtcaggcagtatggaggctgtcccctcccggtttattttttccagatatccggtcagctccccgacccttttttgcctcttcttttgcacatgcccatacagccctgccagcaggagcagaaccaccgccgtgcccgcaaaggccgtccctatggaacgcttcagataaccggaagcaaaatccgacagccggtatccatatgccgacagatagtccgccgttttttccgcctcccgtgcaaccggctgcagccccttctttaccagaagcatgatttccttttcctcctgcggatatgcttccaccaggccggccgtgacttccgtaaggatacgcttctggctcgccgcaaaataccgggccaggagcactcccacacacatgctgcaaaacaggcagcacaaaaccgccagaatacctgccgccataaccgactgtttcttattcattcctccacatcctccatacggtatccgaaaccgcgcaccgttttgatacaggccggattcgacagcttctcacgcagccttttcatggcaacggtcagggtattgtcatttacaaaatttccgtttgcatcccacaaaagctccagaagcttctgcctggtaagcgtatggtttttatgctccaacagcgctgcaagaagctggtattccagtgatcccaggctgatttcttccttattaagaaacaccttcatctgatttttatccatggaaaccggaccgcacaccaaatagcttcccccggcctgcccggcccgcctcagaagcgcacagattctggaatacagcacctccagttcaaaaggcttgaccagataatcatccgcccctttctgaaaaccgttcacaatgtccctggtatcgcccctgaccgtcagaaaaatcaccggcagcatgggccacttttcccttatccacctgcacagcccctctccgctgccatccggcagattccagtccaccagcaccacggagggcagccccttgcccagcagctgcttcccctccgcaaccgtagcggccgttatcacctcaaagccctttcttcgcaggaaaaaagccactccctccgcgattcccgcatcatcctcaatataataaatcctgtgggccatatctgcctcctgtccatgttttgcagtctccgcctgcatccgattactgtatttacgcccctgtattgcactcattttacctgctttccatatgtatttcaagaaataaggttaaatgtaaaggatggttcctctaacaggctctcccgctaagacctcccgctgagttaaaatcccgcagtcctgcctcccctggtcacagtacgggaaatcctgccacaaatgtatggtaaaactgtggttggctttctccttaaacaatggtatgatatactgtagatacataaattcataaactatggagggttaaattatgaaaaagaaaatgctgtgcctggttaccgcactgttgctgggagtgctccttggcgcctgttcaggcagctccgcagaaaaaatgttcggggtaaagcttccctcgggagataagcttaagctgtacatgagccgcgccgatgtggagaaaatcatgggggacgaggaatacaaactggtaaataatacctatgattatggctatatcacccttggctacacagatggcttgttatcctacatctcttttaacggtgattccactgtttccctgttaaacggattatcattgggtgataccaattatgataaatatgattttaccgtctacaacgataaagacggcaacgcctattataaaaataacaacgggaaatatgaattaaccgatacctttgatcccaaaatggaattccaggacggcgttacggtcactatttatttatcttctgaaaagaaggtagaaagcgttatggttctcgactcttatgttgcaatggtacgcaggctggacggctgacgctgtacccatcaatgcagagcattccttatataagtataatagaaaaagattcgcgggcagttatatccgcgaatcttttttatatcgtgcccatggaaaaacttcactaaaaagccagtacggtagacaacccctgcctgagcaccggcagcgtggtataggcctgtaccagcaaagtagggttttccagcttgcgcagcagcatttgtgctgcctggacgcccaaatcataaacatcaatgtcaatgacagtgggcgtcggatcaataatggaggaatagggatagctgtcgaaagtcaggaaggcggcttcatcgggaatctgcagctgtctttcatggagagccttgacgacgccgagcgccagcgtattattttcacagatgaaggcccggggaggtacgggcagggaaaggacctcatgtgtctgccggcaggcatcctctctggtggaatctgtgtagcggatgtattcgtcaggcaccctgtagccatagtcatacataccgcccagaaaaccgttcagccgctgggtggatatatgatccgtgcgccgttcaccgatgaatgcgactttttcatagccgcattccagcatatgctgcgcggcaaactgccctgccaggccgttgtttgtgtcgatccagcacatacggcttccggggccgggatggccgatatggatatggggaaaccggctttccgtaagcagcctggagagctgcgggaaggaacaggaaccatggatgagaataccgtctgccagccctttcccgataagcccggtgagatattcctgcggttcggccgtatccgggaagtccgtcagcatcagcgtatatccatgctccgccagagttcgtcggacgccgcagagaatgtcaaacatatgtgggttgcggtaggcctcctcttttttcaggctggataaaaagagaatattatgggacgcgccctttgcaaagctgacagccctggcattgggcgtataatgcagcttttttatggcttcgtgaacccgttcacaggttgcgggggaaatcgagctccagttgttgagtaccttggaaacggtagaggtggaaacaccggcctcttttgccacatcgcttattgttacagccatgggaacctccttgtgaaaaagtgataagtttaaaattatagtatagcggtttcctaacaaagtcaacgtattttacaaaaaccgatagaaatgggagtcgataaatgctataaatgacttaaataaatggtgcgcatccttatttgagaaataaaagttgttttgggtaagcaaaggacattgttaatcaggaaagcggtttcgcagaaatggaggacgtgaaatgaaaaagatattgtgttatcttctgaccggtatcatggcggcaggagtgctggcaggctgcggacagaaaacgcagaccggcacggaaaatacagcgccggaggaaaaagaagccgtacagacggaggcctcctcccagccggaagctccggtacaacaggaggctccggtacagcaggagccgggtgaggcggttacactcaccgcatggcatgataatgatgaagcgatgatgaatgcgctggcggatgtggtgaatgaagcgctggcgggggaaaatatcaccctgaaatttgaaaagaaaagcgatgtgaccggacagatcaagctgtacggcacggatgctgaaaatggccccgatatgtacctgtttgcccatgattcgctgggcagcttcgcggaaatgggtattctggagccggtggggaacctgataagcgcccaaaaggaagctgatctgctgcccatgacaattgaagccgcaacctacaagggagaacagtatcttatgccggtttattatgaaaccgtgctgtttatgtataataaggcgctgtgggaaggcgagattccttccaccacagaggagctttacgactatatgacggctcacacggataccgcagccggaacctatgcgctggtgaaccagcattccaacacttataatgtggccccctttatcaacgggttcggaggctatgtcatcgataaggatggaaatccggggctggatgcgcaggcgacaaaggacgccatcctatacaatgaaaagttttccaggctgcaggctgacggggattataatacggtaaccgccctgtttaatgaagggaaagcggcggcaattataggcggcccctggctggtatccggaattaaggaagccggcattgatttgggcgtcaaagccctgacagattttacgcttcccaacggcaattccctcattccgtattccggtgttcagtgtatcggcgtattaaaatatgctgccgaagcaaaaaaggaagcagtgacaaaggtgctggaggtactcgccggggaggaagtcggaatcacgctggccaaaggattcaactgcgcccctgccaacagcagggcctatgacgacaaggaggttgcatccaatgaaatgatccttgccatgaagcaaagcgcagaaaaagctatccccatgcccaacattcctgaaatgagcgttatgtgggggccggcagaatccctgcttgctgcagtcaacaaatccggagaggatgtggacacagcagctgaaaaatatcaaaaggaagccctgaccgccatacaggatatgaaataattttgcagtccggttatgcccggagcattgcatacagacatgaaaaatgaatgcggcgcttcctgtacagcccggccggcgaaatccggccgggacaaatcagaagggaatacaataaaatgatgaacgtaaagcacagcgctccccggaagccggatattccggggaagcggaagcatccggtccgaaggcagctccgtccctggggctacagtctccctgccatgatattgattgccatgattgtactcttcccaatcctttataccggctatatttctctgaccaatatgaatctttatcattggacggactattccctggtcggtgcggataattataagagggcgcttctgaaagtggattcaggcttcctgtcggccctgggcaccaccatactatggacggctgtcaatatggtgctggacacggctatcgcctacgtgcttgccgtggccctcaatacacaggggctgaaggcgaagcgcctgtacaaaaccctgcttattttcccctgggcgatgcctgcttatgtctccattctggtatggcgcgtgggaatgttcaatacggagttcgggctgcttaataagcttcttgtggcattcgggatggaaaaagtggatttcctgtccagaaatgtacccgcctttatatcctgcatggttttaaatctctggatgtcacttccttatatgatcctgatgatggacggggctttgcagagcatcgaccagagcatgtacgagagtgcggtgctggatggagccaatctgtggcagaagaaccggtatattaccatcccttccctgaaaaaaatcatggccccggcggtgatcatgaccacctttatcacctttaagcagtttgatattatctaccttcttaccatgcagaagggctcagtaaccggggctaccgtgtcaaccatcattacctatgcccatcagaatgcatttgtctccaataattatggattatcctctgctgtatccatgatcatttttgtaattattatcctgttttccttctggacaaacagggcacagaaggaggaaacggtatgaaacgctctgtaaaaagaacgattggcctggcttttttaaatctgtttttcatcagcatatgtctggccggactgattccgatactgtatgctttcctgctttctgtcagcagcggaagcggggcgcttaccaccggcctttctctcctgccggaaaaattcacgctggataattaccgcagcatccttgtggaaaagcccttcctgaaatggctttttaattccgtcctcctaagcacgggtacaatggtgcttgccatgggaacgagcgtcacggcttcctacgctttttccaggttccgtttccccggccggacggctgtcatgcagctgcttcttctgctgaacgcctttccccagattttgtccatgttcgctatcttcagactgtttaagctgctgaatctcctgaattcccatgcagggctgatttttatttattccgggagcatgtgtattttttccatctggaacatgaagggctatttcgattccattcccgttgagatcgaagaagcatccaaaattgacggggcaggcaatctgacgctgatagcgaaaatcatcctgccgctggcacgtcccgccattattgtaactgccgtcatggtattgatatttgtctggaatgaatacctttttgccactacctttatgctccgggaagaaagctatacgctggccggcggcctgtatcagcttcaggcaaacgattacagccgcagctggcccctgttttcagcggccgccattttagtatcggtgcctatccttattattttcttctgtatccagaagtatatggtgtcagggctgaccgcaggcggtgtaaaaggttaaaaaccaggaggaaaatcctctgctcgccagagggctcgcattttgctccgcaaaactaggaggaaaatcctctgctcgccagagggctcgcattttgctccgcaaaactaggaggatttgaaatgaataggagtgcggttgcgcacataccggcgtcccagtacgctttcgcccggtcggaggatacgtttaccatccgtctgcgggccgcgaagggggatctggatttgtgtacgcttttttatggggacagggcttgtccggattcaccggtaagctttgcgtccatccccatgcagcggcgttacagcgatgagctgtttgatttttatgaggggactatccaaccgtgtccccgcaggatctgttattttttcaggctggaaaagggaggggaatatgtctggtattatgcggatgaattccatgaggatatgccggatctggtgatggaggatggctttgttgttgaggggcggagtgaatactaccagtatccttatatcctgcgttcggaaatcgtcagggcgccggaatggtttctgaatgccgttgtctacaatattttcccggacagctttgcagacgggaaggcccggctctgcggcatgggaaaagagctgaaggcgcctcacggcacggtgagcaaaagccgtctggggggtaccattaagggcattatggaaaatcttgattacattcaggagctgggatttacctgcctgtacctgaatccgatttttcaggccggggaatatcacaaatatgatattgtggactatttccacgtggatccctgcatgggcacggatgaggatttcctggaattgacacaagccgtccataacagaggtatgcgcatcatcattgatggggtattcaaccattgcagctggtatttccccccgttcgacgatgtggtgaagcatgggaacacttccgcttatgcagactggttttacgatctctgctttcctgtaaaaaggcctcaggagggagaagcgcccggttatgcctgcttcgcctatgagcctaaaatgccgaagctgaatacggcccatcccggagtgcaggaatattttgccgaagtgggccgctattggatcgagaaattccatgtggacggctggcgtctggacgtggcaaatgaggtggataaaaatttctggcgcagcttccgttctgctgtgcgggaagcaaatccggaggcggtgctgattggagaggtctgggaaaatgcggcggactggctgaagggcgacatgtttgattccgtcatgaactatgatttccgaaagcactgcagagatttttttgcattggaaaaaacaggggcggatgatttcctctggaggatggccgacatgcagctgcgttatcccttccaggtgacggcggcacagctgaacctgctggacagccatgatgtggcgcgtttcctgggattgtgcggaggcgattatgaccggtggcaggcggctttcctgtacctttgtatggctcccggagtgccaagtgttttttacggagatgaaaaaaaggtgaccggcatccgggaaacggagtacagacaggggatgccctgggacgaaaaccacgccgattcggaagactttgtaaaaacagtcctgcgtatccgcagggactggattgccccggcggatgaatggagagccgtttatggcggccatgacgacagactggtagtatttgaaagatacggcgcgcatacggtacgcgtaatcatccacatgggagaagctcccgcagatgccgaacgcttcatgaacggcggtcagcttcttcttctgaagggctcggtttcccatatgcttgaaaaaaatggctttgccgttctgctgatggcataaaatgtcataaatgctgctttccggcgccgcagctctcctgcctctccatcttgaggggcaggagttgtttatgccggagattacctctcctgcgttttgcatttcagcacatgcaccgccagttcccctgatgttgaaaaagtatttgtcccccgtcaaaatctgtggtatcaggtttgcgttatttgctaaggacgcctttaatccttcgtactccggcagaagaagactgttctttttgaatactgaaccttcccaagtttgcagtatcgcttacatgaggtcctccacatacttctctgctccaaattttccccttgtcgtctttcattgtatacactttgactatatcagggtatttatcccaaaagttaccttcaacgccactctcttttgcttcatttttaggcatctcagaaatatggacaaccgcttttgatgaaattgcttcgttcacatatttttccacctttgcaatctgctccggcgtaagtttttcatcatggttaaagtcaaacctcaaccgttctgaagtaatattacttcctctttgatgaacatgatcacccaaaacttcccttaatccagcaagtaataaatgagcagcagaatgtaatgctgttgtttccgttgattggtcagctaatccacctttaaatttacctgcggaagctgttctgctcttttctgcatgtcttttttccgcctctgcaaaagaagccctgttctctatgctacatccattttcagtcaggaattcctccgttaattccagagggaaaccatatgtttcataaaaataaaatgcatctgcccctgtaactttgcccttatttttaagatgcttttgtatttcaagttctccttgctgcaatgttttatagaaaaggttttcttccttgtttattatctcaataactttctttttattactgtgcaagtcttcataagctgttgcttcatctatataaacttcagacaactcacccataaaacttccttgtataccgatttttttacctgcacgaatcgccctccttaataaccttcttgttatataccctgcgtcactatttgccggctccgcaccgtcattgattagaaaaactgctgctctcacatgatccagtatgatccgaaatgacttaaaatcgtcagcataatcttttccgcttaactccatcagttttttcttagcattaaaaaagaatgccgtattaaaaacatccctatcatcattaagagctgctgcgaccctttctaatccgcctccataatcaatattgggattctgcatttttacaaagccggtgccctcttttttataacacataaatacattgttcccaatctctaaaaacctttcgctgtcagaagcaggatgatccagtgaattaccatctggttcaaaatcatagaacatttcactatctggaccgcctggttcaccaacaggcatgtctaaaggacttccagctctgctccaccagttttctttttcatcatataaaaatatttttcctcctctggataacccatatttatatggattatcctcaacgacaggctctatacctaccgatttgaatttctctgaccagatttgaattgtttctatatctttctgtatattccaatcatcacttcccttaaacacactgatatataacctgccggggtcaattcccaattcgtttatctgccaattccaaatggcatcaatttgcttattcttatagttattttcatttgctttaaattcccatcggcccagcatttcaaaaaaagttaaatgcgaggtatctccaacttcatcaatatccactgttcttaagcatttctgaatatttgttatttcattgcctattgggtgtttttcccctaacaaatatggaaccataggctgcatcccacttccggtaaacaatgttgagggatcattttccggcagcaagccagcggaaggtacttgactggccccttttcttttcatgaaatcaatatatgatttccttaactcatccggtgtcatttttaccatgcttaatacctccgtttaatttgttttttaaaacaaaaaagccctaagctgacatttatattgtcagcttagggcgaactctcctgtccgtgttaccacctaatttcagatttctctgcactctatcaatacgggatatctccgatattgtttcctgaataacggtggaattccgttgaagcctactgagatttatccgttcggttcacagctctgagactgcttcaatattagatcaatgaagatttacaccaaccatcttctctctgcgaaatccctaatacttactatttctcgtcaaggcctttttgttttaaattagactgatgttatcacactcaaattgctctgtcaatataattttccttttttatacgaattgtaacgaagtaacacaaaatgcaacacgatcaaaaaaaagtaccgtaaatacggtactttccaatggagcatatggggctcgaacccacgacctccacgctgccagcgtggcgcgctcccagctgcgctaatgccccgtccgtgatatatcatatcaaatgtttccctgcttggcaagaaaaatttttaccattttctcattttttccacattttattttcctgccagcagcggcctcatctgtacttcccggaaacccgcattttctcagcctttcccatcaacttcttctcttccgggcaaagcacctcctccagctctctccggtgaagccctctcccaataaatacggcacgggaatccccgccgccttcatagccggtaatactgtaattcctgtccaccacatcgaatctgagccatgcgctgcctgccggaagataccccttggcccgcctgatatcgccgaacacgcctgacaccactccctgcagaaacagaaccagctggttaccggactccaggtgtatggaggtaaagcctgcattctccaaatccggctgcagcgtttccctctcccttttcttcgcgttctcctccccttccttcgtcagatatctctcaaaaagcccattccaccaggaagcctctttcttctcacaggaatccgtcacaatctccccctgaggattcattgtcctcacttctgacgcaatcctgcaaagctcctccgcgtccattgcccctgttttggtaaaaataaccgtggctgcgttttcaatctggtccctgcagatttccgggtacttttccttatccctgtcaaaagcgggcacatccagcaccgttaccggctgcagcagtactattctttcatattggatctggctgatattggtaaggatatttcccagctttccaagccccgtcggctctaccaccaggtattccggatcaagcgtattggaaatcgtcagtatggaggaagcaaaatctgccttcatcgtgcagcagatacacccttccgtcagctcccacaccttcatttccgcctgccctgtccccgatgccaaaaaaccgccgtcaatccccacttcaccatattcattttccatgaccacgaacctcttatccgttttttctgccagagccttgatgaacgtggtttttcccgctcccaggaatcccgatattaccagtatctccataaaattatcccctatgctgcagctctttcctgaaaatgcgtgcggtccaaacaggccgcacgcacacattttccgccgtgccggacaaggcatgctattggcatcccgtatccgtcaggaagttcaatataccctgatatcagtcctcaatcttcactacgggcttaatcagatccttcggcttatccctcattaagaacagcgcctcttccacatgatcccagccttcaaatacatgggaaaccagaggatgcacatccagcttgcctgcggaaaccagcgatcccagcttctccatacgcagacgtccgccgggcatcaggccgccgttaatctgcttatgtcccatgcccacgccccattccacacggggaatgttaacataggtgccgctgcccagataattaacattgccgatttttccgccgggcttcaggcacttcacggcggattcaaaggtttcacagcctccgcccgctacaactaccttatccacgcccttgccgtccgtcagcgccagcacctgatcctcaatggtcccgtccttatagctgataaaatcagaagcgccgtagcctctggccgcctccacgcagtttggcctggtacccaccgcaataatgcgggacgcgccgcgcatattcgccccggccaccgacatcaggcccaccggcccgattcctattacaaggaccgtatcgccgaactgtacatccgccagttccacgccatggaagcccgtaggaaccatgtcggaaagcatacaggcgtcaacagggctgatattggaaggcagaagcgccaggttcccgtccgcatcatttacatggaagaattctgaaaatacaccatccttgaaattggagaatttccaacccgcaagcattccccccgaatgcatggaatagcctgcctgcgcttccagggagttccagtccggagtgatagccggtacaagcactctgtcgccgggcttgaaatcctttaccatagagccgacctcgaccacctgcgcacagcactcatgaccgagaatcatattatgcctttcaccgatcgccccttcccagagcgtatgtacatccgacgtacagattgctatagccagcggcttacagatggcatccatgggcccgcactgcggtctttccttctcgatccagccggattccccgattttaagcattgcataacctttcataaaaatacctttcctttctttgaaccccaataccataacagttgcgctgataataaatagatgttaactgttccggacggccgtctttttgaatggctcttccatgcaagaagccccggaagtccatccgatgtaaatgttggcgcaaaaaaagtcttataagccagcttaacacctgctttgcaccaatattcccgccgacctgaactgttaccataaattatacattcttgttaaaaaaaagtcaataaaacgccccatcatattcattttatattataaaacattttttgttcacagttttccccggcacatttcacaaatcgtccccaacaaaaaaatacgggcgggtagactatccctcccgtatatgctatattcaactataaacatcttttcctgttaaatttctttttcaggaatacgtcccgcccacgaaaggagacaataccttatgataaaaaaacaaatgactgacatcctgctcacagcggccctttgcattctgacagcctctgtcctcacaggatgcgcagcaaacggtaaaaatgatgcctcgggcgtacaggaaagcccgtccgcttcccagggacaggccgaaaatccggctgccggcaatactgctgccgcagatgccggaaatacggcagacggcaaaagcccttccggaaccggtgcatcttccgataataacagttccgccggaacatctcccgccgcctcatcatcctccgacggcaccgaagcctctttggaaggccaggagggcggcgcagacgcaaaagtcatagagtcccagaccttctccggagtcagcctgggcggttacgaaaatgtacagttcaccacccgcgaaatcacggaaaacgggcgtacccgtgtggaatattcccttgtctcggacggcgatgccgtatacaccttcccggacgcctatgattactggctgtttgcctccgaagtaaatttcatcgccttccgcgatgtgaacggcgacgggcaaaaggatgtcatcacaagcgagcagtacatttccggcgccggagacggtggtacggtgcccttcagcatgacgcgcatttacctgaatcagggcagtgaattcctgttcgcagatggtctgtccgtttccatcggcaacagcctggatgcctcccgtcccgaagaatataccattgaaaatatcctcgctatcctggaagagccggtttactgtaatttcggcagcggcggctggaccagaggagaaatcgaaagcttcgcctttcttgtaaaaaatgacgttctaaatgataacagaaaagccctttcacaaaaaatcaattatccgctaaacctggtcagaaacggtgaacagctcctgatttcatctcctgaggaatttcttgccagctacaatgacatcctgaacctgcaggtcatctatgatgtggaaggctcggaaaccgaggatcttttctggaaccaggacggcgtcatgctcggcaccggtgccatctggttcggcaaaatgcaggacggcagcattaaaatatacgccatccccgcagaggtacagtactgtaaccccctggatgtggactagccccttttacctgatttccagcttttcgcatacccgcttcaggacaaatctgtaaaagccccagatacagagcgtaaccacgcccacaacagctgcgcagcttccaagccccgccagctcaccgggcgtaaagcgcccgccgtcgttcatgtaaagaatcaggcagtaaaacagatagattgccacagttcccaccgccgcgggcgctttgaatacctttcccacctgccccctgacagaattcattaaaaagtcatgccccgcgcccagatgctttaaatcctcgtaaaccagacggctgttcatggcaatggtcatgcatctggtatatataataatgaaaacagccgcaaagcagatcagggaaataaataaaaacagcattaaaaatacggcataggtggacaggaagtccgttttatccaatatacggaacataggcgcatatttccagaactgcttaaaataaaaggactgatattccttaaagctaatcgtaatgtcagagccgctgtcttcatattccccaaaactgcccgcacgggcctgcctgtcataaatcctgtcgtccattcttgtgacctggcaatcactgcccgtgctggcaacaatctgcctgtataattcctgtgcaaacccataggagccatccacgtccgccacattaaaggccaccagccgctcacgccactcatctgtaagcccttccgatattttcatataatctttgtcattgagcacataatattttccggaaagcatattgtcacagacatatccatcgaaggaaatccccagcgtttttcccgtcaccggattggtaagcatggttgtgtcgttggcaagccagaacgcattgcccccgtcctctccgatgaccgcccggcaggttccctccggtacctctatatcctgcttcgctatccggttaaactccgaagccggaaggtagttcccctcccccaccagctccctgtactcatagtggaaattccgcctgctgtccatgatctgcgtactgccgtcgtgggcaagcaccgccagaggatatgtgctgtattctgtaatttccacctgatagctttctgcaagcgcctttatctcctcttccgtaagcatatcctgatcctgcctgtaggggaaaaggaaatctatgggcctctcatcaatggctttctgcgagccagacagcatcattggcgtataaaacgccgcaaaatacgcgccggcaagcaaaaccgttattaccagcatgctgttcaccgtctgccgcccctggaacttcatcatgctgccggtaataatatcccgccagcgcttcttccctttttttcttccatggacaacaatatacagaagaagcatgtaaagcccgacaaacaagggaagataggtcacattgatccacgccgggcaataccagttcagcaggcggacacagagcatcggcgtcatatatccgcagactccccccaggatcatgagaagaatccccgcccagccataccatggcttcacatccctgacaggctcacactttctctcattatggacaatggcaatcacatccgtctgcctgataaaaaggatccccataaaaatcagaagaaccatacataccagcgcataacagacagaaatcccataagcttgcaccccaatggaaaaagaagtttcatccgtatttaccaggaaaatacagaaaagcttccagatacagaaggcgagcggcgtccccagcaccatgccgcccaaaaaggaaatgcccgaaaccaacagcagctcccgcagcagcctcgccccaagctgcctggcagaagcgcccagcgccataagaatcccggtttccctggatttgtattttaaaaacagggccgcggcatacacgacaaataccccgcacccaaaaacagccaggaaaaatatcatcgacacctgcttgcgtgaatccccgccctccggcagaatggtaagcacggtaggcgactgcatcataacggcataagccgtaatcaacagttcggataaaaacaggcacaaaaacagcaggtaataatttttccggttataataacgcagctctttatttatctgtctctggtttttcattccttttcttcaccctcttcccccatttcttcaataatttccagcagttccttctggaagtcacggtggctgccgctgcaatatgccgttttgaaaatttccccgtccttcagaatgattacccggtcacagaaggacgcagcgaagctgtcgtgcgtcaccataaaaatcgtggtgtccagttcctccctggcccgttcaaaggactgtatcaccgtacggctggatttggaatccagatttccggtaggctcatccgccagcatcaggagcggcgaattaatcagcgcccgcgccacagccgtccgctgtttctccccgccggatatttccgccggatacttatccctgatatgctcaatgccgaatatccggcacaggcgcgccgcatcctcctccattgcctcctccgtctgtccgctgataatcctgggaaggagaatattatccttaaccgacagtccatccagcaggcaaaaatcctggaacacaaagcccagcttcctgtttctcaccaccgccaacccctccgcatccagactcgccagattctgccctcccagaactatttcccccttctggaaaggtatgtagcaggcgatacaattcaggagcgtggacttccctgaacccgatggccccataaccgccacgaattcccccttctccacctcaaaagacacatcccgcagcacaggataggtctggctgccggtctgataatttttatacaaatgttccacacgcagcatctcaattacctcctttgatgtcccggcattcagggccggacagttatcttcccgtccccgggcctgcccctggattttctttccggtatgtcagccctccggtcacttttattataggggaaaccgcgttttcaaaagtgagggaatgtgtcaaaactgacatgaattccgtcatttttggatgaaactgagccgtgcgcttttttcggggaagggaatgtgatacaatatggaacatcaaaagggagggaatgccatgcttcagattgcgattgcagatgatgaaaagaaaccgcgcagggcactgcgggatattctggaaccctggcttgagctgcaggcggttccctgtcagctgtgggaatatgagtccggggaaaagctgtgtgagggatacaggaaataccactttgacctgatattcctggatattgagatggaagggatgaacgggatggaaaccgccaggcagctgcgttccatcgaccagcatgggattctcatattcgttacggcttatcccgattatgtcttccaggggtatgaagtgagggcattccattatatcctgaagccctatcaggaaaaacggctcctggacatcacggcaagggcgctggaagaaatacagcagggggacaacgatttttatcttctcccccagggggcgggcagctgccggctgaaccttcgggataccctgtatttccgcagtgaaggaagatatataacagcctttgcctgcagcggggaaaaaagcttccggggtaagctgaatgacctgcaatcccagcttcccggctattttatcagaatccaccagcgctatcttgtgaatatccggcaggtttcccggacaggggattccttcgccgtcatcggcagtgaaaagctgcctgtgagcagggcgcataagcaggcgttcctgattgcctttgccggagcaatgctggacgtccggtaaaccgaaaactctgtaaaagttcagaaaggtttgtctgatgagaattgcagtattattgatgtacagtataatgggtatcctgtttttaacttccacctgcttttaccagcgcctgaacggcgctttcgtaacgctcaggaaacagcgcctggtaaaggcggctgtttatattggcctgtccgtagtggtaaatacggtgatactcagccaggatgccataaatatcaccctggcctttctgggccttattctccttcttcttgcaggctttgaagggagcctgcttcacaagctttccgccgcctttatcctgtacccctttatcggctccctgaattatcttatttccgcccttatgttaccgctgctcccttccgtgtatacgcaggccaaccgttatcaattcatgggctttggcgtattcagaagcataatcacctgtctgttctggtttttcatgtcccgtatttttgcggaaaggctccgttatgtgaaggaatatctcaacgccgggacgctcatactgctggacctggtatccctgactcctctgctttccatgatttacattgtcactaccgcgtcacggagcatgttaccctatagtctccccgtcattctggccaacctgcttacaaacatgggaattctcgagctgatcgtgcgcatggcggaaaatacccgcacggcggcggaaaatgaaaacctgcggctccagcgggattattatcaggagctggaacacaaccagcaggaaatcaggcggctgcgccacgatataaacaaccatctcaccgccatcggcgcctgcctgaagcaggggaacacggaggaggccctgcagtattttgacgggctttcacagaccgcctccgtcactggcaggagcttctgcacaaacggcctggtaaacgccatgctgaataccaaatataacctggccctggaaaagggactggaaccctttttccacatcgagcttacagaaggccttccgtttgacaatatcgatctgtgctccctgtttgccaacctactggataacgccatagaagcctgtgaaaaagtgcctgattcccagtcgcgtctgctggagctcaggacacggtgcagcaagggctttttcagttttcaggcggttaattcctactgcggcccgcttcgcttttccggcggtgtttatcataccacaaaagaggagccgggcagacatggctttggccttgcccgtgtgagggctgttgtggacaaatatggaggaacgctggaaatacggcatgaacaggggatttttacggtgaccataatcattccggtaaaataatacctgcctcagcggaaaagccaaaatgtcttcccgggcacgcagacggcaggaattaactttcaatcacgccctaacattttccttccccgccaaagccgcgcagcccctgtctgtattccgtgggcgtcacgccgaatttttcccggaacagcttggcaaaatgctggcttttctgataacccacttgcttcatcacctcgtgaatccgcagatccgtttcctcaagcagctgcgccgccttttccatcctgacagaggttatgtagccggagagattttcctgcgttgcctccttaaaaacccgggacaggtatgccggatgcagatgggccgcctctcccaggacatccagcgacaaatccctgccatagttctcccggatgtatttttttatgtaagcgatggtatccgtctttttaaagctgccctcttccccttccttctgcacttcttccgccgtcatctccggtacaagccgttccaccgcctccgccagatcctgctttaataccggcttcaccagatattccgatactccatagcgcagcgcctgccgggcataggtaaaatcactgtagccggaaatgatgatcacctttgtccggccattattttccgcagtcatctgagataaatccaggccggaaacccggggcatacggatatccgtaatcaaaagctccggttcgtgctccagcagcagatcccgcgccagggaaccgccctttgccgtcagcaccgtatcaaacccatagctttcccagtctatcagcttacggatatagtcaaccatatacatctcgtcatcaacaatcagtaccttcatacttctccctccggcaaaatggcaaaggaaaccagcagacctccccagacactttttccaaagcgcagtcccgcggatgcgccgtaatagtttaccagtctctggttcacattccacaggcccacgccccattcctcatcccgctgcttatccgcaagacggctcattaaatccccaatctgttcctctgtcatcccgttgccgtcgtcggaaacctcaaaatggatttccgggctctgcagccggtatattttcacatagatatgcttcgcattttctctttcttcaatggcatgatttaccgcattttcaatcagaggctgaagcagcaacgggatcagccgtactccgtaaagcgcttccgatacatcgattgtatactccacatccctgcgcatggccataacggaaagataggctctggtatacgaaacctcctcacccaccgtggccatggatttattctgggtgcaatatctgtaataattggccagatgcaccgccatctgggtaactgcctccggcttgtccgccaccgttacgatgtaagaaaggctgttggaaagaaaatgcgggttaatctgcagctgaagctgccgtagctcggcctggtcccgaagctgctgttccttaagtatggatgcaatcagctggcggattctcattaccatcctgttaaattgtgcaaatacataggaaaattcgttctgcggcatctccacagctgagattttggcatcaaaatcccctttctccacctgcatcagctttccggtgaggattctgatttgcagcaggatattccggtaataaagaatcaggaaggccaggccgattcccatcagcagaagaagcagggcgccggtcacccaggtaaccgtgttgacaggcttgagcatctctttcagcggataataggtgataagatgcagtccgttaggggcgggcgccgctgtgaccagctggtatttcccctgggcaatcgacacctcataagccatttcttccgtttgtttcttctgggctgctttttcctgcggcagcgcctgcccttccatcgttttcaaaagggcctgctccgcttcattgacgtagaacaggctctccccgtcagaaaaggtgagcagtgcgcccccgttctgcacgccggaagccatatttttgattttatacagatagtcccgctccatacggatgagcagaaagggttcatcatcgtttttatcccagtccgtcacatattttctggaatagtacacctcgcccctgtacagaaaccacaggttatcctccgcaagctccagagcctgctcttccacgccttctatgttcagcgtactgataatccggccggaagcgggccagtataaaatgaattcagccatccccacattgcttttctggcggctctttagataatccttcatgcgattggcgtctgtcacatactgccaggcatcataggcttccatcagcgtcaggtgcagcgccttcagatcctcactgtgaagaatcccctccgcctcgatttcgatctccctgaccttctgattgagctgcgcgctcgtatagaccatctgcatccgggccacccgcatcagcgagtccttcagcgccgtggtgctgtagcggaacagaatcgcaaagcttgccattgtcgtaaataggaaaataataaaaataacgaaaatggatttgattttctccatagcttctcccttttcctgtaaaacaggcgccggctgcggcaggcaaacggacagatcacaagaaactgccgggggattcccggcaattcttgtttcatgcattacaacttattttttcacattacgataccattcattaatttctttggtaatcgcatcgccgccctgggctttccagtcttccacaaatttatcaaaggcttccacaggctccttgccgtaaataatatttgtatacacctgcttttccatggtctggagctgttcccagttctttttcatggtagctgtgggttcaccgttaaacagattgggtatcagctcgtccttatgctcgtacgccaccacatacccttctgaggtggccggcgaagtgacaaagctggccttggccctgatctgcgcgccggatacggcttcttttccttcactgatatccgcataggcctgcatggtgtccagagaaggtgagtttttcagtacggtggacttgccgggaaggaacggatctgtgaccggcggatcaaacaacgcggaatcaaacaccacttctccgtccacgatatcataatcacagccctccaggaagccgtactggaaatccccggtgccgaaggccacatcataaagccagtcataataagtgaaaaaggcttccatattgttgaaatccttattgaacatcagccagccgtcattggtctgtgcggactgatacgtaggttccccgttctcctgcctgatattgggataagccttgattaccgcctccggcgccacactggtcacgtccttaacggaatcaatggcccagggacgtccgataaaaatacccgccttgccttccgtgaactgtgtcatcgcatcccatgcgctggtagccgcagcctcctggaaaatccagccgttagcgtgccactgcgccatacgctccagtgtagccctgtttccttcatttatagaaccgtaaaccagctccccgttttcatcctcctgccagctgccgggaatgtattttccggaattggcggaaaacaggatgaccggatccgccacccagccattgttgtaaatgctgtcgccttcataggtaaagccataggtgtcttttttcccgttgccgtcaggatcatcctcggtaaaggcacggattaccgcttcgaactcatccaaagtagcgggcgctttcagccccaggttatccagccagtcctgccggattaccatgacctgtccctccgtcagaaccggagcgcatgcaaggccataggtcttcccatccttggtgaccgggtaaaaggtctgcgggtatttgtcgtagatttccttcagccggtccggcatatatttttcaatatcctcgtcaatggctttgacgcggccggattcaatcatatccgcgatcatctgtgtcccatatacgggaaatacgtcgggcagctcctccgaaccggtcagcgcaaggcggagcttggtatcatagttgttcgcatcccctcccagcagcgtagtttccattttaatgcccagcttttccaccgccagatccaccatggggtttttattgatatcctcgccgtccccgtaacggcccgcattttcatccagctgctttgcgatattgatcgtaaccacggggtcgtatctcccctccgcgtttttcgtgcccgcggcctgtgtgctttccgccacctttccgcagccaccaaccagcataacagctgccagcgcaattgtcagcaatgcctttcttttttccatatcttacctccactttttattttatcgtgaatcctcctgaaagaggaatcagaatccggtaaaccggttcagagcatgtttggaaattgccctgaattgctcactcctttaccgcccccataacaattcctgtcacaaaatatttctgcaggaacggatataccagcaaaatgggaagcgcgccgataaatacctgcgccgccttgatggtcctctcggacatggcggccgccgaggtgggatccagcgccagatcctgttggttcccctgtaccacaatcacctgcaggaaggacgccagcggataattcttggtatccgacatataaaggataccggtaaaccattcattccagtttcctaccatgataaacagcgccacggtagccaggcccgccttggaaaggggcagatatattttccacagcaccttgaaaaagctggcgccgtctatcagggcggcttcttccagcgccctgggaatggatttgaaaaaattcataatcaatatcaggttgtagcagctgaacgctcccggcaggatataaaccaggaaattatttttcagccccagggatgtattcacaaggtagctgggaatcagcccgccgccaaaaagcatggtgaatacaaaaaaccacatcagcgccgtcctgccgcggaactccttggacagcgcatatccggccgtggtgatgacaaacatgccaaacagcgtccccgcccccgtccgcaggaaggaaatcaccagggaacggataaaattgctgttatggaaggttttgatataggcaagcgtagtgaaatccaccggccagaaggtgaccagcccgctgttggctgcacttttcccgctgagggaaatagcgaacaggttcactaacggcaggaagcacagaagcgctaccagaatcagaaatatggtattgcacagcacaaatatttttctgctcaaatgtgtacgtcgcataatagtctctccctcctagaaaatccggtagccggcgtatttgtaggcaatcctgtaagaaaccacggtgagggcaaggctgatgctggacttgaacagccccaccgccgtaccgaagctgtactgcccgttcaccagtgactggcggtaaacataggtgtcgataatatccccggtggaataggtcagcggggaatacaggttgaaaatctgatcaaagcccgcattcagcacatttcccaggctcagtgtcgccatgacgataatcatcggcattatccccggaagcgtgatatgcagcgtctgctgccaacggtttgccccgtccatctccgccgcttcatacaggttctggtcgatattggaaattgccgccagataaacgatcatgccgaacccgaagcccttccagagatcggatatgaccgctatctgccggaacatccccgcctctcccagaaaaaatatccgttccatgccaagctttgtcaggaaaccgtttacaatgccgtcaaggctgaggatatccctcagcatccccgccaccgtaacccaggaaaggaagtggggcagatacacaagcgtctgtatcccttttttcagccccgtatgatggacttcattgagcagaagccccataacaatcggaacgacaagacccaggacgattttgctcacggcaataatcagcgtattgatgattgcctgataggactccttaaaggcaaaaatctgccggaaattttccagtcccacgaattcagaatccagaatccccagccagggcttataattctggaaagccatcaccaggccgcccataggcgcatagcagaaaataacagccagaataatgcttggcagaagcagcagataaagcggccagctgtgataaaattcctgtttccagcctctgcgcgccgccgtcattcccccgccgctctttgcttttgataattttttcatatccgcatccccttttcccataatcgtaactgttaaatgcctttacagttacgttctttcatttaagaagattatataataacggatgcgggcggtcatacaccccgatttcaaggttgtgtaccctgattttacttttttgtgaaaaaatggaagagagcgcgcgtatatttgtattccgtgtcttccgttttacggcaaaagaatagcgggccttttcagaattgctccgaactgcccgcttctgcgtatccgagtgctttaatcggtcagacacctgcctgacccgatgtttttcttacttttctcacctttcccttgatgggcttcgtctgcagccgttccaggaccagcgggcccttccggttgaggatttccacataagtaaggctttcccggatatctattacaccgatatcctctgccgtaatgccgtcaactgcgcatatggtccccacgatgtccgccgtgcgcattttggattttctgccgcctccgatggacagcctcatgatatcccggttaagcgcctccccttttcctgctttgggcgcagatttcctgcgctgcagcgcccagaaggctttttcttcctcctgcgtcacaatcagctcctgtaaaaccggaagggccgttcccgtatactcctccaccttctgcagcattttcttctcctgtgcagaaaccaggcttacggcgcggccgtccttcccgtttcgtccggtccgccctatccggtggacataggtttcttttcctgtggggaaatcataatttaccaccaggccgatgttctcaaaatcaatcccccttgccgccacgtcggtggcgatcaggtaccggaagccgccgcggccgaatgcgtccacatttttcagccgctccttctgctccatttccccatgaatcatgccgcagaaaatccggtcccgccgcagcttctgaaacagtacgttaaccatttccctggtgccgcagaagatcatgcagctgtcagggttttccttcattaacaccctcttgaacatctcatacttattttctgcggtgacctcataaaccgcctgtccgatggaaggcggcgggccatcctcctgatcctgcgccacaaaaacagcgtcggctgcataattgtcgatcagggtctgcacctgtttttccagagttgctgaaaaaagcaggattttcctgttttccggcagcagggaaatgatctctcccacctcttccaaaaagcccatgtccagcataagatccgcttcatcaatgaccaggtgggtgatgcctgacagctgcaggctgccgcggcagacaagatccatgacacggcccggcgttcccacaacgatatgggatttctgtttcagggtctgcatctgtttatctatgggaaacccgccgaatacggccggtaccttcagccgcttcttccttccgatttgaaacagctcccggctcacctgcaccgccagctcacggctcggctccagcacaagcgcgcggggagaattttcttcccatacggccatttcgcagaggggaactgcaaaggccgctgtttttccggttcccgtccgggaacgcgccaccacattcttccccgccaggacaagggggataacctcctgctggattgcggtgggatggtgatagccaagcatatccagggcctccaggattggcagggatagtccgtaccgggcgaagccatgggacgcgggcgtgtttttattttctgtactcatgcattggtttccttttttatcattttttattgtaactgttcgtctcacagttacgttttatttttccttctccaccctgcttacccgggttttccgctttccacacagcggcgccgtttattactccggctccctggcatacttttgcgtaaaatggtatcataaagatactgtatcaccataaatcaggacgtatggaaagaagaaaggggaaaatatatgtttgagggaaaaatcgctgtggtaaccggcggcgcgcaggggatcggcaggaccattgccggggaatttgagaaaaacggtgcgaaggtatgtgtgattgacaagcagcccggcgtctattataccggtgacctggctgacgagaaaacactggagcgctttgcggcgcaggtaattgccgactatggccatatagattatctgattaacaacgcgctgccattaatgaagggaattgacagctgtacctggcaggaattcaactacgcgcttaaggtgggcgtttctgcgcctttttatctgtcaaagctgttcctgccgtattttaatcccggcgcttccatcgtgaatatttcatcctcaagagatcgcatgagccagccgaatacggaaagctacaccgcggcaaagggcgggatagaattactcaggtgtcctttacttcttcaagcaccagttcattttccggaagttcgtccaaaaaactgacggacagaacggcctgcggccagttcaggctgacttgcgcatattttccccggtcgcgcgccgttccttccagaagctgcagcagctcagtcagcttttccctcgtcagatatccgccgcgccagtggaaggtcaggtttttcttttttttgattgcctgcagcgctcttttttccacatcctccgttttggtgaaggactgcttttttaccagataataaaacaggtttccttcgctgcagggaggcgctttgtaaagaaccggctcatgatcccggaaaaaggcgctgtctgagaggttaaaataatcataccggatattgtccccagtacccagggaattgtcaaaggtggcatccaggtgacagtactttccttccgccctgatgatattccaggcatgtctgtacttaatgtttttctccggattggcctcggaaatggcgatcatacaccagattccaagggcgtcgcacaatatttttaccgttttagcaattccctcgcagacgcccacgccttgtcccagcgggccgatgatttcatgggaatagggctttttcagtttatcatagcgaacgccctggcagataaaatcatggatataaagctccttttcccacgctgtaagcgcctgtgccgggcggatcagcttggcgatccttgcttccattgccttctggtgttcccggatcttcgccttctcaaacagatactcgggaaccagctccactttggtagaatccggataaaaacggtattgaaagcccacggcataaaaaatctcagggcagtccagacgcagctggaaaaagatatcccccagtacccggttttccagccttgtaaccaggaatgagggcgcaagggcctgaaggcccgctttcatgtcacgataagcagcctgctgttgtttgtccagctgcatataatagtagggttccatgttgtactccggttttgttttatcttacgtcctgctgcaaagggccggcaggctcagctatcctgggccgtacagaatagaaacttctctttctccgcctttgcataatagagggcggtatcggcttttttgaataattcgccaaagtccgccgcatcgcggggccagatcgacacaccgatgctgttcgtgcaggcaatgccgtctgtctcaatacgcgtcaggccggacagcttgccccacagccaccgttcattatcaatgtccctggccaggataataaactcatccccgccgaacctgcctgcaatatccgttttcctgaaagtattctgtattttctccgcaactgctttaatcaccttatcgccttcgaaatggccgaaggtatcattaaagttcttaaaattatcaatatccagcattatcagggcatgcttcatgtggctttccctgcgcagattttcagtaatcagttttattgtgtgttctttattataaaggcctgtaaacgcatcaagcttaaccgcctggcgcaggcagtccgtctgctccttcatatcggatatatccgtgatcacccccaccattcttgccggtactccattctccatgacaggggttacaaaaatcctgcaccatatatagccggaattccctgccttcatacgggcttcataggcagtggatttccccgccagaacatctgaaaaggcattctcaatcacagcctcatcctccggatgtgaaaaatacctgcttacggccagcctgtatgcctccggatccagcctgctgtagggctggacatccttcaaaatggattctccggaaacaccaaagatgacttccgcattttcaaaataagtatacagctgcttctgtatatccacctcaaaaatacagatttttgcggcggtcagcgccacatgcagccgttccttgtactgtgtcaactcattcatggcggttgggcctctttccccgatgcaatattcaacagtcgctcttttctatattagcatcctttatgaataaaagaaacggtaaatatgaacagcaaataatttccgtgctctacttcgccgcccagctgtccgccgtcttggcctccgccacacagggcaccgacctgaggatatccttccccgcactttccatcaccgtcttcagacgcgccgccgcctccaatgcttccctttccggtacctccatcaggatttcatcatggacaatccccacgatcttccagtccctgcccacaatttcctcaaacagcaggcccaaagcccttttcaggatatcggccgccgttccctgtacgggggtattggccatatcggccacgccggatctgggggaaaacaggaatttccttccggtaagcgtcctgccctcccagaaggttcccaccttcaggtcatgatgccaccagctgattcccgcataagcgttaaaaaaactgtcccggaatttcttagcctcctccagcgtcatatccacgccgtaggactgggctgcatactgctgcagccccgccgcccccattccgaatatcaggccgaaattcaccgccttggccgcctgtctctgggcggacgtcacctgttctgccggaatatccgatatgagggaggcggtcagcctgtgcagatcctccccgcgggcatatgcccccttcatcctcacatcccccgaaatctgcgccgccacccggagttcaatctgggaataatccgccagcaccagctttctgccctccggggcgataaaacagctgcggaaacgggcttccctgggaatctgctggatattcggcccccagcagcacattctgccgctgtatgcgccgatctgcccatatttagggtgcagccggcccgtaaccggatgtatctgcgcaggaagaggatgcaggaagccggaaagcagcttggaatatctccgataatcggtgagcgcttttaccagaggatgattatgatatagcgccaggctgtagcgggaggtgttcggcacatggatgccgttatcccgcagcagcctgagcacatagacattgctgtcaaaattcacatccacggcttcctgcgttccccacagggtcagctggaaggtcggttccccgctgaaggcatataacgccttaagcgacttctcatactgctcctggatatccgcgcacaaaacctcccactgctccagatccagacagatcccatcatattccgtccaggccagcgccggcgcacatgcaaattcaatctgtgccaccctctccagcccgttatcctgaagctgctttcccaggcattcccacagccgcagcagaacaccggaatccagcgccgcatattcaagcttggacgcggtcagggaaccgctccagtccccggtctgctccgtcttgtccagcgtctctcccagataatgctccgacacagccgccaggttcaccttacgcgggccaccgcaggggcgcagcagctccgccgccagcatggtatcgaacaccggcgccgcgcacactcccgcttttctcaaaaactgcaggtcgaacttggcattatgaaaaattttcacactgtcaccctccagcgcctcccgcaggaacgcggttcccttttccggcccggccgtcctgtcacgcctgtcctccgtcccgccgccgagaaaggaaaaacagtctattaacagcacgggcataccgggagcgcctatctgtatgagtctgagcctgtccctgtgcacgtccagccctgtagtctccgtatccaccgccagcacaggcgcctttttcaactgctccagaaaaggttccccttcctccggggtacgaaccaggatatactccatgcgatcatccttctttcctttttgctgctttcattataacagtatccctctgcaacagcaaccgaaatatcaaacatatgttcttttttatattattgcccgcaggcggtgagcaggcaataacgttgttaaaagaagcactttttacaatataatcagtgttttttctgtagtgaatgcattctgcctctcgtataataataaaaaaggctgccaatacaggcagcgtggcaccaaacacataaggaggggcgctatggaacatctcttttcggcaatcaacaatatcttcaacttcgttatacccgtttccgactttttctgggactttcccaccaatttcagctggtatgcctccattcccatcctggggaatttttcactggcggtaatgctgctcatcggctcgggcatctatttcagcatcaggacaggttttatccaggtgacgcattttggaaagggaatccgcatcctggcaaagaaaaaaagcgatgaaatcggcatttcctccctggcggcgttcttcctgagctcagccatgcgcgtcggcccgggcaatattcttggcgttaccggcgccatcgcaacaggaggcccgggcgcgctgttctggatgtgggtatccgcatttttcggaatggcaaccgcttatacagaagccgtcctggcacagattttcaaagaaaagaaaaaagatgagttcgtaggaggccttcccttttatggaaaggtgctgctggggaacaagctctgggcaggcgtcgccctgtcgctgatgtacatcatctacgccatgtgctgccttcccgcccagggctttaacgtggtaagctccatcggccagatggctgaaatcgttaccggcgcttccatgggcagcgcttcttatttttactatattgtatccgttcttctcatcctcgttaccgcctatatcgctttcggaggcatccgtaaggtcaccagggtcaccgacgggctggttcctgtcatggcagtgatctacgtgggtgtggttttcctgctcattctcctgaacctgggaagcgtcccctatttcttcggcgcggtgttcggaggcgcatttacgccccaggcagtattcggcggtattttcggcacggttctggtacagggcgtgaaaagagggctgatgtccaatgaagccggacagggcaccatcaccatggccgccggcgccgccaatacggatcatccctgcgaacagggctgcgtccagtccatcggcgtgtttctcgataccatggttatctgcacccttaccggcttcgtcgttgtcatggcgcatgtctggaccggcagcagcgctgaggcctggtttgccatggatcgcctgcctaaattcctggaatccgcaaaggtgcttaccccgggtacggccatgaacgcggcagtggccttcctgctcaccttctgcttctgtctgttcgccttcacctgcctggtgggaatgatctccttcagcgaaatcgcagccaaccggatcagctccagcaaaaaggtgatttataccgtccgcattgttggcattttcatcacggctttcggtatcgcctgctccctggccggaattgaactgggaaatctctgggccatctccgatctgggcaacatcctgatcgtttttgccaacattccccttctctatctgggagcaaaatgtgtgttccgcgccaccgcccattttaaaaagaaagacggaacgccttttacctcttctgttatcggacgcagctgtccctactgggatgaaagagccggtaaggccacagataaaaaaacagattccgccagataatccccagccccggcaaaaaggacctgccagcatcaccggtacagaagcgcaagataatgcataagctgtatcaccaggtcctcttttcctttggggcattcctccatcagctgttcaatcagctggttggaattatgctcccctgtaatcaggtaggtagggtcaagctctaaatgtttcctgaccagtaaaatcctttctatggtaagcttcctgtttcctctttctatctctccgtaatacgtttctgaaattccaagcagctttgcagtctgcttctgtgtcaaccccattttctccctccgggcccgcagtctgtccccaatatccatcaacagcttagattcaggcatttcttcccctctttctccgctaaaacgcgtacacttcccataaatcccttcaaaaataaattacaaggaatttacctcatccgccgtgctttgtcaacatgcgcaaagccgtaatccatggcgcacagggaaatatttatagtatcaaattcaaggaattgcatattattagtatattgaaagataacttccgtatttatagtcttttatatggaggtcggaaaaaatatggataacatctcgaaactggttggggccagaatcagaggatttcggaaggaaaagcatttaagccaggaggagctggcagaaaaatgcaatcttcatcccacttacatcgggcagctggaacgcggagagaaaaacccgacaatagaaagtgtcatgaagatatccgacggactgcaggttcccttagaccagctctttgccaatgtcactgctgccaactttcctgccatggattatattccggataaaatcatgtttcttgtaatggaactgactcccaaagaacagaagatcatatatgaattaatccttctggcattgaagcttcgtaattaaataatgaatgacctatggtaactgtgaaggaactgaacagttacagcttatgaaaaaatgcagcctcaggtatctctccggctgcatttttctgtaggtttttattctgaaaaccgcagacgaggtttacgccaccccacgtaaacactgcttctgcggttttctttcttttttatccggacccggcagcgccggaaccggaaatttttttacttaagcgaacggattttccgtaggatacatcatgcccttaggctggttgaagttgatttcatccgtttcaacaccgatgtatttaaatacttcatacagagcctttccgaaatgtccgaaagcaactgcaccgtggtgaggatagttcttctcaaccaggacatgacggtagaagcgtcccatttcaggaatagcgaatacgccgattccgccgaaggaacgggttgccacaggcagaacctcgccctgtgcgatgtatgcgcgcagcttggcatccgctgtgctctgcagacggtagaaggtaatgtccccggggatgatatctccttccagagtaccctgggtaacttcttcaggcaggcttcttgccatgatgaactgatatttcatctcgcagaaggaaagcttgctggatgcagtatttccgcagtggaagcccatgaaggtatctttctgggtatagtcatattttcctttgatgtcggattcaaacatatctgcgggaactgtattgttgatatccagcagagtaaccacatcgttgctgacaacggttccgatgaactcactcagagcgccataaatatcaacttcacaggataccgggatgcctctcttggtcaggcggctgtttacatagcagggaacgcagccaaactgtgtctggaatgcgggccaacattttccggcaactgctacgaattcacggcttcccttatgttcttcgatccagtcaagcagggtcagctcgtactgagccagcttgtttaagatttcgggcttcttgtttcctgcacccagttcttcttccatatcctttacaacttcagggattctctcatctcctgcatggttgttgaaggcttcgaacagatccagttcggagttttcttcgatttccacacccaggttgaacagctgtttaatcggtgcgttgcaggccatgaagtctttcggacgaggtccgaaggaaatgatcttcaggtttcttaaaccaacgattgccctggcaacaggtgcgaattcagcgatcatatcagcgcattcggaagcagttcccaccggatattcgggaagatatgctttcaggttgcgcagcttcaggttatagcttgcattcagaacgccgcagtatgcgtcgcctctgccgcttaccagattgtttccggtttcttccgcagcagccactaccatagccggtccgtcaaattccttgattaacagggtttcaggtgtttcaggtccgaagtttccaaggtaaaccacgattgcattgcagccggcttccttcacgtccgccagtgcttttctcatatcgatttcattttcgatacatacagggcactcataaaggccgtccccatatttttccttgtaagctgcaactactgcttttcttctggatacggataaatccatagggaagcagtcacggcttaccgctacgatagcgattttttctttcggcatgttgttcatttctttcctctcctttcgcggccataggccgcactaaaatcaggggagaagcgtcttttgcttctccggtgggacacaaggtgtcccatcctctcctttcgcggccataggccgcactaaaaactggcttattttacacagatgttctcgcccttcaggccgatatggcatccttcgggaaggccgccctcggcatgtccgatgagccatttgttcttggcagtgatcagcgcatcctcgccgcctgcacagtggttctcatccagcggcagattggttccgtcggggagaacgatagcacagcggaagccttcctccgtgctgttgcagggcgcatagtgaagtgttgttgcataaagctccacgcccacacccttaggaagcagaaaagcttccaccttagaggtatcgtaagtatagccctcttcgatatcctgctgccagccaagcagcagaatcagatcggaagccgccacgtcgatctctgaggatctgtggtactccagcgcgttcagcttgtaattattgccgttgcagaagccgatctggatcggcatttccccataggcagtatcctgaagctccttgtatacaggaagagcctccagctgttccacgcttggctcataaacaacttcctgtgtacagggtgtcttttccagttctgcaaccagagccgtaaaatccacattgtccactacccttccgtatttccggaaagcggcgtccgttactttcttaatttccatccctcttctcctttcttttgttcagtctatttttagattcagccggaatcagccggcattatcagcattgagaacatccctgcgcggctttgcccacagccgggaatttattaaataatcttgtcaaacagttctttgcaggcaggataaatctgtctgaactgctgatatctttcctcatatttcgcagtcagctccggatcaggctccacggttcccacaaccttcaccagcttgtctgcggcttcctccacgcttgcgaactctccgcagcccacagccgccagaatcgctccgccgtagccgggtccttcttcgctttcaatcatgtcaaccttaataccaagcacgttcgccatgatcttcttccagagagggctcttcgctccgccgccgcagatcttggttctttcaatatgtattcccagagacctggcaacctcaaaggaatccctcagtgcaaaagcaacgccttccagaacagcctgcgtcatatcagccctggtggtatccatggtcatgccgatgaaggttcctcttgcattggggttattatggggagaacgctctcccatcagataaggcaagaaaaatacatggttttctcccagctttgtaatggccgcctgctccgccgcataatcgcctgtgccgatgatatcatccatccaccacttgttgcaggaagccgcgctgagcatgcatcccatcagatggtatttcccgtccgcatgggcaaacgcgtgcagcgcattgttgctgtccacgcagaagcttctggaggaaataaaaatcgttccgcttgttcccagggaaatattgcacatgccgtcgcccacggttccggttcccacagccgcagccgcgttgtccccggctcctgcaatcacctttacattcccgggcagccccagctcctgtgcgatttcgggaagcagtgttcccaccacctcatagctttcaaaaatctgcgccagctgttccttacggatgccgcagatttcgcacatttcttccgaccagcagcggttcttcacatccagcagtagcatgccggaagcatcggatacatccgtgcagtgtacgccggaaagcttatatgcaaggtaatccttgggaagcataattttttctattttggcaaaattctcaggctctttgttcttcacccagagaagcttcggcgcggtaaagcctgcaaaagcaatattcgccgtatattcggacagcttatccttgccgattacctgattcagataatccgtctcctcactggtccttccgtcattccataaaatggccgggcggatgacctgatcctccttatccagaattaccagtccgtgcatctgtccgccgaagctgatgcccgccacctgtgatttgtcacattccgcaaccagctccttcaagcctgccatggtctgctcaaaccagtcctccggcttctgctcagaccagcccggatgagggaaaaacaaaggatattcctttgaaacaatcttcttaatcgctcccttttcgtccatcagcaaaagcttgaccgccgatgtcccaagatctacgcctatgtataacataccgcgcctcccgtcctttccttcttaaatgcggctttcaatgcgacgcctcagccagccttccggcttccccaaaagcaattgcccgcatgccgcctgttttttgtccgttcttacgtgcccgtgcacgttactttcataataaatgatttccttccaaaaatcaatggggtttgtcaaattcgttaaaatatacaatctaccttgttttttgcggccttttgccatcctcttttgtataatctgctgtttcgtgttgcacgcacacgattttcaccctttgaaaattgactttgcccgtttattatgttacggttatggaaagtgtaactgcaaggttgcatacaaccatcggataaccggaatttacattgccataagaatccggaacatttctgccgggcgcctgccgcgggcgtcctgtccggcagacgggaaaatattcgtttttctttgaattcaccgtttaacccgccgccagcagaaataatcaaagcccccgctgtaagcaacgggccatcaaatttgcagcgctgcagagcagcggggcatttgaccctcgcggcagtcgccaaatatccatgcaagcatggctacctggttctgcccgcgggaataaaaaagaaatcagaggtgaaccaggcatggctacgattaaggaaattgccgagctggccggagtctccaggggaacggttgaccgggtcctgaataaccgcggggcggtaaatcccaagacggcccggaaggtactggaaatagcccaggcgcttgattataaaccgaacagggccggcatcgtgcttgccgcacagaaaaagaacctgaaaatcggggtaattttgttcgatacgggaaatccgttttttaatgatgtgatagaaggggtaaataaaaaggcggaagagcttggcggatataactgctccgtcctcatttcacgcgtgggcttcgacctgcaggcccagctggacgccatggacaggatggcggcccagggtgtgaacggcatcgtgctttccccctataacgatccgctcattgccggcaagatcaatgagctgagtgaaaaaggcatccccgtgatcaccaccaatacggatattgaaaactccgcccgcctggcctacgtgggctgcaacttctaccgttccggggaaaccgccgcgggactgatgcatctgatgtcggacggggaggtctatgcgggaattatcagcggttcctccaaggtactctgccatacggaccggattgcgggcttcagggaccgggtgcagtcacattaccctggcatccacatcgtggatacgattgaaaacagcgacgatgaatttgaaagctatgacggcacgctgcggctgcttggagagcatccggaaattaatgccctttattttgcggcgggcggcgtatacggcggctgccgggcggtgctcgcttccgggcggcgcgacattaccatcatttcctgcgataaggttcccaccacaagggatatggtgcttcagggagtcattgccgccaccatctgccagcagcccctcattcagggcaccaggcctttagatctgatgttctcctgccttaccaccggggaaaaaccggaaaaagaataccattatacgacggtggacatccgtatccgggaaaacatctgacttatgcggcagcagccggcagaaagcatttttcaaacacactcttgcgtcaggacatcttttcagttcattcctgctgcaaaaaaagccgttccgtgcggcggaccaaccggttcacctgcacggaacgacttttttttgtatgatttcagcctattgccctgttactcccctcatacaggccactgcgtatcagacggaggaagctcttcccccctggtcagataaaaccggtcgaaccgcatgcctgacgccatggaatacacctgcagcgtgtggctgcctttttctaacagacatctggccgcagggacccatctgtaaatctgctccgcctcataacggtgcagcgccccgccccggtacaattcttctttggctaacggatgtccgtccactcccatggcaaaataagcctcttccatcacatcgaatttggacagcatccagacggtgtattccccgccttcacactccagctgataactgagggaaggcgcttcggacggctccttccatgacagccccggtgtcctgacatacatggccagcccgctgcgcccataggattcactgccgcagtgctgccatagccctccgtccgcgtgggcaaacctgctctgagccagggccgccgccgcatcaatccggatgctgccgttattttccgcaaacggatgctccccttcctgtaaaaagaagcccggctccaccgtcttggcataccgttccgggtacaggatcctgcttgtcaccgccagcccgtcatccccgcattccgccggggcgtattccaccggccggggcttaagcgtcagcttcccgtaaaaatcctccgtccaccggtccgcatcccagtcccagggaagctcctgcgctccggtaatccccgccagattgttttcctttctctccttcgtataaatcacgaatccggaaaaagcaaaatatttatccaccgcatacagggaaatccggtgtaagccggccttcatcgccgggagggacagatacaggcgatccacattgttaagcacgtttttcttccagtttccacgccactcgtcattggaatacgattccagtatccgcaccggcccttcgtccacggaaacacctatcctgatccggccggtggaatccagcgacgggaaccggtgaagctccagcaggaattccccctcactggcggcatacacctgataacaaagaggcgccgaaaaaccactgtcctccctgacggcctccataaggctcccccggcatctgcccagccgctttatgacgtgaaagtaaggggaagaaaccgtactttgcgccgaaacggcctgcacgcagatacagccgtcctcctctgtattttcacagacctgtgccggaggctctgtttttaccggaatcctcacctcgctgcagtccgaaagatcctttacgagaatctccccttccctggcggcggtacagtcctccaccctgaccagaatccttttttccgtccgcacgcttccgctgttttcagacaaagtcatccaatccggcgcggttatggtaaaatcaaagcttccctgtcccgcatttcccagctccagccattttacgccgggcttcctgaacacaagctccgtttcctcgttccataaatgcgtcagcattccacgctctccgatagaaagcggcggcgtacagacgggcatctgcgcggcgcgcggcggcgggaagccctccgggttcaggatgccgtcccattttccatccgccatcaccttattatagtacagaagcatcttcctcctggcatcgtcaaactgcatggatttcttcgtataatatgcggcggcctgcatttttccctgcctgtacgcaagtgtgctcctgtcgccataataaaactgcagattcgtaaaatatcccgcatagatacgcatgagaaccagctggaaaaatgcgtccttttccttttcgggaagcgcttcgtaaatagcgttcccgcgggtaaaaagctcctcatatttatggatacgcactacggcctcgtctccgtaggcagtctgggaaaaagcatcatagtccatattttccagctttcttacattggtaagctgggaaaaatcattcaggagcgctgaaacctctttcccgatgccgccctcaaaattacggtcgatccagtccgccacataagcgtccacatcctccgtcagcgcattttcactgccgatttcccaggccaggcgcaggaaaaattcaatctcctgctccagcggcttcatggcgccgctgtttagcacccacagcttgcggattccctcattataagccttctgcagctcatttctcgtatgggccagcggtatggagcacaggaacacataggacatgctcgggggcgcccaataggaattatgataataaataccgttgcctccgctgcgttttttctccttttcggaagggtatctgcggatatagccgtaattgtcgttcgcccagacaagcgtcatatcctccggcacctcaaggccgtggtcatacagatccagaacctctttatatggaataaaggtcatcatcgtatcatggcccagcgtatcccttaaaatactgcgctgatccctgataatggtttccagaagctccaccttggcctgccgtttttcctcctcgcttttgttttccagccccctcgtctcaaagccggaatcatggatgccgcgcatccccagcgtatagcagacctcaaaatcctgattctgctccacgctctcccgccagtattcctgcaggatttcccggtttcttcctggtacggaatagtcgtaaaccgcatcctggtatcccttttttgctatccagggacgccattcccgattgttggaacgcatcagcatatcgcaatgggaggttcccaccacaatgcccatgcgttccgccagcgcgccgttttcccgtttactgttgaaggaattgacatgcatggcaggccatatgtagtttgcctttaaccgaagaagcagctcaaacaccttttcataggtcttcacgccgatggtttcctcgcccatgtgcttctttacccaggcctccagctcttcctcatcattgataaaaatccccctgtattccacggaagggtgatccgtcctgaggaaatcctccggcagacggatttcctgcttttccttcaccggtacatccgcccagaaataccagggggaaacgccgattttttcacagaattcgtagatgccgtaaatcgttccccttctgtcgctgcccgcaatgatcagccttccttcccggacacagagcagatacgcttcctttatcagcacgcctttttcatcccgcaggaggtttccggcaattctgtcaatgtcctcacacattccgattgttccgatacggatttcggaataattttccgcagaatccacttccggaacggctgcctgtgcgtcctcatcgccctgcagtcctcctcccagaaccttttccaaatccttttccagattggaagccgcaatttttaccgcatcggattccttatcgcttatcctgatccggtatttctgtccgcgttttatgtaaaaatccatacgtttctcctttcatcctctccggctgatatcacctcatgcctgtatgatattttgtaactgttcagtacccctcacagttactgctaaaatccatcctaaatcgcctttggcgatggattttagcactcttgaatcactttcttacggtcagcgcagtaaatgcgctgacctgctgaacagttatgatattttcatcatatcataaagcgggtatttttctgcaacattattggcaaaaacattgcgtatcttgactttatattctgactatatatttttactttatattctgactttatacttttactttatatttacacttttatattcgcttcgtactttggctttgcagcttcaaccgccgtcccattcatccgcagattaccatcagggctgctccttctccctgttccggatcaaaaaacgcctcccgccatatcctttccggcgaaaaaccggaaaatacggcgggaggcgcattatcttactgcttaagccctgggcttctgtttatttaactacagtaagggaagtgatatggggatttacgccctcataccagtacaggaaaccttccatatcaacggtctggccgatttccagagactgtacagccttgtatacatcggttgttttgtcacacaggtaggattccacggtgaaggtgtaggtttctccattataggaaacgttgaaatataagtcgtcgccttctgtaccggaaccgtcccagttatacaggtaagccacatcattgccgtcggcatcctgtccggcagcctctaccgtcatgcccttaaaggtaacaaactggttctgatggtcgatcaggccgtcggttcccagtatatcggtaacatccagcgcgtcggcgataaactcatccccttccacaaattcaaaggttgcatccatcagctcgatttctccggaccattctgacttgtagcctgttacacggatcttggttcccggaacaagacgctcataatcttcctctgagcatgccatattgtacaggaaataagcgccgtccttatcctggctgtaaacggtggccttatcctcccaccaggactgctttgcctggacataagtctcgattaccacctgggaatccagatcggcagccatatactcttcataggtcataaccccggcagcggcgtctgcgctgtctgtggtgaccgtctcagccaccgttgtggtttcttccactgtagccgccggcgtactctcttcctgagcggtctctgctgtggtgctcactgcttctgaagcagcggttgccgccggctcccctgtctttgcacagccggcaacggccagtgccatggaaagcgcaagcgcaagaacgatagtctttttcataattctctcctttgtgaataaagttttaaaagctgcaggaactcaggtttcccaagccccttcatgagttattatagcttaaaaataaaagaaatcaatggtcatgtctcattttttcttctccatccaacaatcagataggccaaaatcagtatccaggccgccgcaagggaggaaagcagcgccacggcagtgcccgggagcggacccagatcggtttttccggcggtctgtgaggcgcgttcatttaagtggtaaagggccgtcacgtcggaaaaaagcttgtccatgtaggcatcgttgatctcttccttcctcctggcggattttgccacattctcaatcagctgtccggcagcgtcccgcagggaagcggagccgttgaacaccggcgtggtgaaggtatcgtccgtatgggaaagcaaaagctgggaagccttgattttcacgtcataataattatcattgtcctcaccggcccgggacagatagtcctgatactcttcggattccctcgcggttctggtaaccggcacatacccttccgtctccgcataggccgtctgtaccccgtcggaaagcaggtattgggcaaaaagccaggacgccaggacctcctggggatcctccttattaaagatacagacggaaggcccctgggaaatcatctgcggattcgcgggatcaaactgcggaatcatcatcacctcggtttcaaaatccaccagggcttcttcactgatatcggtaagaggcgcatcggtccccatccaggtagcgcccgcagtggagtctatggcaaaaatgcactgcccggcatttaagaagttagccggatagctggaaattttgaaggtggaaaaggcgccgcttttcacatgtcccgcgatggtatacagaagctctttggccgtatcgttaaacagctcaatccggccgtcctccgtggaataccccgcccccttctgtttcagcatctgaatcatcatattgtccgtggacttatagaggaagggaatcatcacactctgtccgttgacgaggaaattcccgtccgcatcctttttcgtggctgcctcggaaacctcccagatgaaatcccaggtcagcgtttccggcagggtatagcccagagcctccacataggtcttattcacatagcaggcctcggtggatcgcatatagggaatggcataatggcggccgccaaaggaacactcctccaggaactgtggtatcagctcctcctgcactggagaatcaaacctcacttcactgccgcccagcccatacttttcatccgaaaacaggccgtccaggggaaccaccacgttgtctccggtgagataggttgcgatgtgatccgggtagctgatgcagacattgggggtggtcccggtggaaatattggttatgacatcgttatatattttcccgtaatccgtgtacagccgcaggtttaccgtgatgttgggatagagctcctgaaaatcctcaatcgcctttttataaatatccgtctgcctcttattggtatcgtttttcgcccaaaaggtaatctcatgctgctttgcggcatcaaaggcctccggcaccgtaaagtccgtgttttccctggaaccatgacagccggtaagcaggagcgcggaggctgtcagcacagccgcggcaagcgcacccgcccggcccttcttaaataagcgcttcatcccttcagccctccccgtgacactccggccataatttttttccggaatactaaaaacagcaggatcaggggaatggaaaccaccacaaccgccgccatcattgccgggatattctcgcgtccgaagccgttttcccggatttcctggattccgccgctgaccagatagtaagcgggatcgtccgtaatcagccgcggccatacgtaggaattccagcactcgattaccttcaggatgatgatggttatcagcgtcggccagcacatgggaatcataaccttccagaggaacttgaaatccgaggtgccgtccacctttgccgcccggtacagctcatcgggcacctgttcaaaattttccttcagcagatagatgtaaaagaccgacgtaaccgacggcaggatcagtcccatgaaagtattgcgcatctcccaggaggtgatggtcgcaaagttggtgataaccaccagctcgccgggaatcatcatcagggaaagaaagagcgtgaaaatcacgttcttccccctgaattccagccgcgcgaaggcgaaggccgccaaagtgatgaccactaccataagcgccgtagtgatgaccgaaaaaatcaccgtattcacgaggtagccgcccagaggcacctgcgtaaatgcatcggcgtagttttccatggtcggcgacagggtgaaaaaggcgggaatgcgctccgcattataggagccatagctcttcactgaggtcaggagcatccagtaaaaaggaaacaggacgataactccccacagcgaaagcagtacatatgtcacgatccgtccgatccgcgcccgccgtccggccctcagttcaattttttcaaaatcagtctgattatccataaatccggcctcctcagtaatgaacgtgttttttgctcaccagcagattgatgcaggtaatggtaaggacgatggcaaacagtataatggccgccgccgaggcgtaggaggggaagccgccgctgtcgccatagagcatgtcgtagacgtagcccacaatggtgttcatgcccgccgcattcagatccgtgccgaacagcgccaccgcatcgctgtacgccttgaacgcgccgatgaagccggtaattaccagataaaaaaccataggggaaatcatgggcagggttatccgcgtaaaggtacgcagctttgaggtgccgtccacccgggccgccttataataatcctggtttacggaggccagcgcgctggtcaggatcaggattttaaagggcatgaccacccatatggtataaaaacacaggacaaacatcttggcccagtaggggccgtcgataaaatcaacggacgggccgccgaacaagccaatcagcaggttgatgagcccgtcggtatactctgtcttctggaacagaatcataaataccagacccaccgccagcgtattggtcacatagggcaggaaaaaaacggtctggtacaaatcccgcagcgccctgatggagcttaagcccagggaaatcagaagagcaagccccgtggagaggggaacggtgatgataaccagaaggaaggtgttttttacggcctgcaggaaataaggatcgtgcagcacataggaataattataaaggcctgtcccgaaataggtctgggaggcgaaattatacccctcctccgcggaatagacgaacacgtcaatcagcggataaatcataaatatactgagaaataaaagcgccggcagaagatacagccaggctttcatgccatgtcggttcataagcggctccttttatctgacctgaaagggaatacgtgcttccgtctgcgggtcgaataaatatactttttcaggtttcagggcaaaacggaccttctctgcatccgggtcagccagctgcgaggcatccacaatcgcacggaaggaagcggcttcgcagtccgggtgagaagctacgatgctgctttcacggcccatcacctccacgcccgcaaggctgcagcaaagaggcccgtcctcccggagcaaaaagccctccggacggattccggccagcaccttaccatccgccgccccgggcactggaagcaccggtatgccgccgatacagagcttgccactgcggacttcgccccggaaaataccgatgggcggtgtccccaggaatttcgccacaaacaggttctgcggattgtcatagacctcctggggctttccaatctgctgcagaagcccgtccttcataaccactatcagatcggaaatgctgatggcctcctcctggtcatgggttacgaacaccgtggtgattttcgtcgctctctgtattttacggatttcctccctggtctgcaggcgcagcctggcatccaggttggaaagaggttcatccagcaaaagcacctggggcagctttaccagagccctggcgatggccacgcgctgctgctggccgccggacagctccccgggcttgcggtccatcaattcgtcaatctgcaccagcctggcggcatcctccgcccttttgttcatttcagcctgggtcagcttgtcctttcccttcagattttccaggggaaaaaggatatttttccgtactgtcatatggggataaagcgcgtaattctggaataccatgcccacgccccgcagctccggcggcagtgcggtcacgtcccggccgccgaagaatatctttccggccgtaggcttttccaggccgcagatcagattcagcgtggtgctcttcccgcagcccgacggtcccagcagaccgattaactgtccatcgggtatttcaaaggtaaaatcattgacggcgatgacctcgccgggattttttctgttcctgtttggaaattttttagtgagattctgcaattcaattttcatgcctctcctcccttcacacattccgaagatcattatatcgcatcctgccaaacaattccagtaacagttccgccattttcccacctgcttgactttcatttccccgtgtatcatactgttttattatagccgtgaagccgtctgcgccgggaggagatatgcgtgttcctttcgttttcccttgcagccaggcgcggcagtcactgccgcagggaggatatatggatggtcgatgaaattataaccgcatattaccagctggattccgaattcggctatgattttgtatataatatagataacacaccgaaaaatgatgcggaattcaagctgcataatcatgataacctgtatgaaatagatctgtttctttcggggaatgcggaattccatatagaagggaatatttacagggcgcatccccacgatatttttattgccaggccttatgaaatgcaccataacgtgtttctgtcttctgataaatatgaaagaatcgttatttttatcagcctggattttttccacaggaaccggtgcggtgagctggaagcctttttccgggagcgttcgctgggcatgggctgccagatccctgcggaaattgtggacagggaaatgtaccagctgcttatgaaggtcaaccggtatcttcaggagggcgcctttgaaattgccagatgtgtgctgctggaattcctgtatctgttaaaccatatcggtgagccgctgaccctccccacggttgaggatgagcgggtaaaaaacattctgctccacatcaatgaaaacctgaccggggatctttccctggactgcctggcggagaccttttttatcaataaatatcatctctgccggattttcaagacaataacgggctacaccatcaaccagtatgtgaaccacaaacggctgctgctggcaaacgagctgcacaaaaaagggcagtccctgctggaagccagcaccaacgcaggctttaacagttatgcccatttctacagaatgcataaaaaggaattcgggacgaacccgcgctcccaacgctgaaaggcgtccgtaaagcccgattattttccccgcaccgcgccggccagccagaaaataaagtacagcacaatatccacaatgacgatgctcgcccccgccggcgttgccaggaggaaggagacggtcattcccaggataaagctgacgatggatacggccaccgcgcaaagaatcacgctgcggtagcgcttgcacacccgcatggcggtgagcgccgggaaaataatcaggctggaaatcaggagcgcccccatcatccgcatgcccagcactaccgtcaccgaggtgagcactgccagaagcatgttgtaaaggccggtcctgattcccgtagccctggcaaaaaccgcatcaaaggtcacggcaaaaatcttatcgtaaaacagcagatagagcaccagcacgataacggacagcactacgctcaacaccacgtcgcttttgctcatggcaagaatcgatccgaacatatagctgttcaaatccgaattcattcccgtggtcacggacaccaccataacgcccaccgccagcgcgcccgtggaaatcatcgcaatggcggcgtctcccttcagccttccgctgtcgcttaagcgaagcaggataaaagcggccaggattaccaccggcaccgccacagccaaaggcgccatattcagcgcggaagccacggccagcgcgccgaagcccacatgggacaggccgtccccaatcatggaatagcgcttcagcaccaggctgacccccagaagtgacgcgcacagcgacaccaggatacccaccaggaacgcccgctgcatgaaagggtatgagaacatttcaacaatatattcaagcatccgccagacctcccagaaattttttcccgaagccgctcttcccatagtcctgtgtggttccgaaaaagtagccgccatgggaaaggtgcagaatatgatccgcatgctccaccgcttccctgatgtcgtgggaaaccataataatcgtaatatcgtggtttccgttcagatcatccagcatggcgtaaaattcctccgtcgccaccggatccagcccggtaatcggttcgtccagtaaaagcagccgcttggtggcgcacagagaacgggccagaagcactcgctgccgctggccgccggatagatcctgaaagctcttgtttttcaaatcaccgattttcagaagctccatgttatcaaccgctctttttttctccgccgcaccaaagcccggcttcatgccacggctgttcaggcagccggaaagcaccacctcatagacggatgcaggaaaatccttctgcaccgcgtcctgctggggcacatagccgatctgcgtggccttcagcccgtctcccgtgacaatttcaccgcccgccggttttttcaatcccagaaggcccttgatcagcgttgttttcccggtgccgttctctccgatgatacacaggtaatctcctgcgttcacctgaaaatcaaggccggataccacaatctggttttcatatgcaaatgatacatttttacaggttatataagacattttcattcctttcggccgccgcttcagggccggctggctgtccttcgccggatgcaggcagggccgctacaattattcgttaagcgccagcttaagctgctccagattctgccgcatcagcgaaaggtaattttccccccgctgcatttcttccctggtaagggtatggcaggagtgcagcatggcggtcctggccccggttacctcagctatggcatccgccaccttggcattggaaagctccagataaaataccaccggaatatgctcctccttcacctcatctgtaaggaaggcgatggtcgccgcactcggctctgtttcagagctgcagccgggaaaagccgcataataatccaggccataggttttcaccagatagagaaaggggaaacgatccccaaagattaccgtatggcgctttgcctctcctattacccggcggtaatcgctgtccagactgcgcagctgctccagatagaccctggcattctcctcataaattccggcgcggtcaggatcgatggagatgagcgtatcccggattttttcaacaatcagaatggcgttggcaggggaggtccatacatgctcatcatattccccttcctccagatgcacgcctgcatcctctgcgaaagcctctgttccgccggctgtctcttcagccgccccatttttaagcgcctcttcttcatggtcatgatcgtgctccctggactgcataccctctgcggtttcctcttccaaaggctccacccattccagaaggctgtgggcgtggacacgggaatcattgccttccagcagctcctccacccatacgtcagattctcctccggcatacagaaacagatcactctccgttatccttatgatatcccggggcgtaggttcataggaatgagcctccattcccggtttgagcagcatatccgcctccacataatccccgcctatctgacggacaaagtcatatggcggaaatatagtggtaattacctgtattttgggcctgccgtcgggagccgtccgggcggcttccttctcctgtcctgccgcgccgcagccggccagagtcaggaccgtaagaaaacacagaatcagcgggactattatcgctgtcagtcgtttcttcatttctttccttttctgtaactgtccgtattctttacagttaccgttttcttctatattcagaagcagattttttcagttcctccagtgtatcatggaatttatgggaagtcatggtggggttgcccttcagcatgtttctcttgatgaagttatggataaaggactgctccttttcctctcccacccgtttgtttccgataaatctgtcacgcagctccagtatttcttctctcttttctttcagcagctcggaagcaggaagcgcttcacgaagctgggcaaaggcctcttctattgtgcctacaagctcttccctgcgctccaggcgtttttccttcttggcttcccgttcgtcgtttgccacggcgataagtacgtccagacgcttctgcatccgctccagctcctgcttggcctgttccgccttaacaaggatatcgcgcagatccatggcagcctggaaggaagtaacgaagtcggcgataaagtataatgatatcaccgcaacaacaagcagcagcactttatgcggaatcaacatggcgatatgctccaccggcttatggataaactgtgtcattaaaatcgtgagaagcccccagcaaagcgtggattccaggcatatctgcccctggaaatttaattttttatgggaatagtcccagtaacgcaccttaaacagcgcctccatcgccacccctgtcacatattccagtacggtggcgccgatacagccggcaatatatatcccgaccagatttcccttcatggggctggataccaggagcatcataatcgctcctgaaccatacaggggaagaaaaggcccgcggataaatccccggttcaccagttttttctgacagatagatacataggtagattcaaaacaccatccgaaaaagcagtaaaaataaaaaaagaaaagccactgtgacaatgtatagtgatacatgctgtttcctccctcgtattctcaaggctttcagcggtaaactcccgccgcggcattcagcctgccctttctggtttccccggcagcaccgtagtaaaggaaccgtccgtagcctcttgcgctcaccatatccccgcttttgagctggcagctgttgttttcgcaaagtcttccattgatgtataccttttttgtccggaagagctccaggctctgattcctggacagctggtacagcctggcaagaatggcgtccgcccgttcgctggaaatgatcagggaaaccctttccggctccctcaccggtgcttccatcccctccgccgccgtctcacagcgcacattggtatgctttaccttcgtcaggttctcacaaagccagggcgcgatccgctgtgtgcagtaaacccacgcatgcctgccttccaaaaaaatatcgcccaccgtacttctgtcaattcccaggttcatcacagcgcccaggaaatcccggtgggtaaaattatccgcaaatttttccaataacgggctgaccttcagtgtctctatgggatacggttcctcatatcccagctcttccggagagccgaagcgggccatctgcctttcgcagccctcgctgccgccccacaggctgaaggaatagcccttctgcgtattcatcgcttcaaataaggcttcctgctccgccatggacaggaagcctgtaaaagtaaaaatattctgtctgtatgatttttctgccagttccagaaaacgtttctttaactgctgcagatctttttctgtttcagccgacatttgtccccctgattaaacaaagctgatgactttttccttgggcgctttggccttcaccacgctggtggcatggagcacaggtccctctccgccgtaatcagcccagtattcctttgaaaccttcgcggtcaccttcacccagtcctgttccttaaagctgtccgcatccctggaaatgcagacaaagcccaggaaagccatatcttccgcacagcaggtcatcgccatgcggcccggcacgaaatgatccttggggaacccgtccggcttcatgaccatcgccgtaaactgcacattttttcccacataacggtcaagatgatccagggaatcaatataccagattccatatcccatatcgtccagtacaatgggatcgctgtttaaatcaaacggaaggtcttcttcgaaaatctcgtcaatttcaccattgctgtcttcaaaaataatgtccgcctgctggttgatggcctttacgttgcgcttatagctgttcagatcctccagcccgtcgcagcggttgaaaataatcatctccgaattccggagcatttccgcaagcagagacttcatgttggtaaaatacatggaaaaggtggacgcgtctattgtggttatctgctgctccacacgccagtgccagggaagcttcatatttttaaagttccacatgccgttgtattctatgatgatgcgttccggtttgatttttttctccaggttcaacaggttctccggggtaaaatcctcctcgttttcgataagctccatcactgtgttgctgcgcttcaaaagcgccggatcatattcattttcgccctcttcacagagaatgagcagtgtctttcccttgatctgaaaataagactgatccagcgtatacgtaataaattctgtctttccgctttccagaaaaccattaatgatatatacaggtttcacaattatccctcctgcataccgcaggcctgcctgcgatactgcatcaatcagcaggttgaagggaacccttcaggcctgccattttcttatcttaattttttgtaactgcccgttgccttcacaattacttttacagctgttccgttccttcacagtaatcgtgcgttgctttattttctgtcaaaaagctccgccagcgccgcttcgttcagcttggatccgattacgcagaattttccggttacatccggctttccttctcttacattgctctcgcctggcacataatcaaagtatacccaggttccgtcccctgcaggcaccatgccctttgcacggagtacgaagccgtatttcttctcatcctccaacgcttccaggatatcggaaatctcatccctcgtgtaggatgcaggcgtttcggttccccaactggtaaacacctcgtccgcatgatggtgatcatggtggtcatgatcatgtccgcagccgcagctgcagccttcgccgtgatcgtgatggtggccgtggtcatggccttcgtgatcgtggccttcatggccatggtcttcatgatcgtgatcgcaatgctcatggccttcatggtcatgcccttcatgatcgtgatcgcaatgctcatggtcatgatgctcatgctctccatggcagcactccccgtcgtgatgatggtgatggccggactcctgttccttcaggaccgcctccatcagctccttttccaaatcctcgccgccttcaattgttttgaggatatcctttccgtccagctgctcaataggagtggtaataatcgtcgctttgctgttgtgctcacgaatcagctccacagcctgctgtatcttcgcttctgatgccacatccgtcctgctcaggataatggttcccgcatgttctatctgattgatgaaaaattcaccgaagttcttaatatacagcctgcacttggaagcatccaccactgcaactgcgctgttgattgttacctcgcttcccatgtccacattctgtaccgccttcaccacatcggaaagcttgcccacaccggaaggctcaatcaggatccgttccggatgatacgtatccataacctccttcagggatgtcccaaaatcgcctaccagagaacagcagatgcatccggaattcatctccttgatttcaatgccggattctttcaggaaaccgccgtcaatgccgatttcaccaaattcgttttcaatcagtactacctggcttcctgccagggcttccttcaaaagcttcttaattaatgtagtctttcctgctcccagaaaacctgagaaaatatctatttttgtcatattacacctctctctccgctatgacggctcttaagcctgcaaacaccaggcccgggtcccggcctgtattctcagctcagcctgcggctattttatatcataaggatgcctttgatcgcatcctctatattttgccccgttttcctcaacttgtcaactctcatgcatgcccgaattcgtgaactgataataaaacgcaatagttccacacatattataaaatttatgttaattccagcttttcccatcaggcggcttaatattcctcagtgctcctcattcttccaaatacttcctcatatgcttcatttaccgtctccatagaaagcgccgccgcgtcatttccactgccgccccccagcatacccacaaaatttccattgccatcaaaaacaccgccccctgacattccgggttttgcctcacattccaggaccatgatatcgcttccaaactcctcgcggaaccatgccttatcctttaaaacagcatgtctggcctcatctcccacaccgtcctcagagcatcccagcaccacaaggggactttccgcatccagggtatcaaaaatcctctgatgcagactgaccaccagcattgtcttttccgctgcatcagaggaagctccattcactttttctttttccggtaaatcctccggcactactacaaaaccaatatccttaacctgacataggccctccgtcttcccggaagtctcccttccgtccggaagaaccacccggagcaactccccttcttccagcaaatgtctgctggtcacaataactatcccttcctccgcaacatcccagatcacgccgcttccgaaatactctgcgccgtttccctgcacatccagccggactatgcttcgttccgcctgttcctgtgccttttctgcattttcgccatccaggctttttgcaaactccacgttgttcaacccggcaccatcaccaacaatcgtgccttcagccgcttcctgactctccaccatagtttccttttcagaattattttcttttttatttgcacaggcccacggagttaccatagccgctgctgcagtgaaagccagcaaaatccagaaaactatagtttttattcgctccttcattaattacctgtttcctccatttttattataggtatgtgaggctgtaatgccccgccaatggcggtatggtaaaagtatttcaacatgcaaggctctcgcaagcctcgactagatgaacaaatcaattgttgcaacaatcccagtatttcaatccacgaggctctcgcaagcctcgacaaagaaaccagctccaaagccgattgagttgccatttcaatccacgaggctctcgcaagcctcgacttttcgctcatgtaaagcctttcgattgagtcgtatttcaatccacgaggctctcgcaagcctcgacagcaatactatacaaaatctatcttactaaaccaagtaataacatactcattatacaacccttctaaaaaattgtcattattatattcttttatattttcataaatctccacatcatccattttccagtgcgaatctccctgcaatttaatgtgcacttataattcacaccgtcctcaatttataattctatccatatatatataataatacattcaaataaccatttaatctttctacattcccagccaaaaggaaaaaggctatcaaacaaaccaagccacatcaattagaattcagcaacgcgtatataatatttgtgctatttgccatacagcggtaaaatcatagtaacataagaaattaaattatatcctgcatgagttaatatgcaacagaatatagaacccgtatgcaaataaagcagacctaatacaataccacaaataaacgctgaaagcgtttgcaccatattaaaatggagtaaggcaaacaacattgaagaaacaaataaagccattacctttccgtaatttgatgccagcccactaagcaaaaaacctctcattagtatttcttctataaacggcgcaagaatgcaaacctgaaataaactggtaattggtgtcgcactcaaagactggagtgtttgctgatatccttcctcacttaccgggaaaaaactttcaaatatggagtctaaccctttatccaaaaggaaatagaacagtatggcgcaccctaatgccaatattaatccatgaaatgaaatgttagaggataaatttaatttgaaactgttttcttttgtcagccaaacaaggaacactatcatacaaaaaataattgaaaacaggttcaagtattctccgtaaataccaggcagctttctccataccacaacatccaaggcagtatataataacataaaaccaaaccagacaagtacccacaaaatccccctgccaagagatactccatctttcataccttatattctccccctctcacaacttccaatctatttttccgcatatggacaaacatctatttggaaacagcattcttttatgaattgcataatatcccaaaaacataatttattagctattattgcaactctatattcacatttccttcatttccataataaacatactccctccatgcttaaatcaagcttcccgccacaggctttacacacgcatccttttatcccatggcgttattcccgtatatctgcacaatgcttattttgttcgtttatgtccagccttctttatcagataatcttcatatatccgatttgctatttttttactaaaaaattcaaacatccattaacggtgtgaataacaaaaaatattgaagccgagccaactaataaataattgctcttccatagtccaaaaaacaaataatacaacggaactactgcaaattggcttaccacaatcaacaaactatactggcagcccagataatataacgtccagccaataaaattaataagtatcatcccaacagttaagaaaaagaatattttttccttaccggtacctatgtgaaaaaagctttcctcttttttgacaattaatattaataaaaccattgataatacaccgaacacaccttgaattctgtctaaccattgtatttcattttgcatattcataatgggattcgatttaggatttattattggcataataagatatggtatttcctgaataacaaaggcaattatccccataaaagaaatccctaaataatagtctttaaaaatatgaaccaatttcataattgtaatcccctccccaaatgctaatttttccggaacctgtgcagcacaaaccgctgtaccggataatcaaattccatacacagttcctccggcacaaaattgaaccgctgatataatgctcttggtgcaattcctttttcatccccttcgcggtatgtcgtaacgctgatatcaacatccggcataagccggagcatttccgaaatcaatgcggatgcaacgccctgacggcggtattggggatggaccgccatacaggaaaggcagtgctggttgggcgaaaataataaaataccaacaatatttccgttgtcctttacgcaaagagctgtctgccgggcgatattcttaagaagtgtttccgtataatcagcaattacaagccccggaaagtcgtcagctaccatattaacaagtcccagccaatctgaaacacaggcttcatcggcaaattctgcatgatattgtttcttcatatattttacttcctccttttaaactcagcccatccatacaaaaaagaacagagcgtggtgtacgtatatatcacctgcctgttcttctgataggaaaataagcaaaactgtaagccgggttatgtcgagaataatcatctatctagtactgctgttaccagcagtctcaagcgacctacctgaaagcaggccgggcaagcctgttgctctctgtttggtcttgcttcggatggggtttacatgtgccccgcctgttaccagacgggcggtagtctcttacactgcctttccacccttaccggggtctgcaccccaaaggattgctcctttccgccaaaggcggggcggtatatttctgttgcactggccttggagtcgcctccaccggacgttatccggcatcctgccctgcgaagcccggactttcctcacctgtcgcatcccaaaaggaatacggacagccgcgattattcatcttacttattttcctttcaatactataccttttttcttccaccttggcaagtgctaaatcaatgaagaaaagtcattccgcagggcaaatataaccattctgccaaaaaagaaagttgacagtccaaaaagcagggcttaggatgataaaggaacacataccgcaaatctaaaactaaaaaaacacaggaggatttatgaaaccttttatcggactgactcctttatatgatgatgataaaaaaagctactggatacttcctggctatatggaagaaattgaacatgtcggaggaatcccggtaatgctgcctttaactgcgaaccgggatatgctggaaaatattttatgccggatagacgggctcgtcctgaccggcggccatgatgtgaaccctgcggtctatggggaaaagacagaggatttctgcggaaggctctgcccggagcgggatgaaatggagctggccctgatacagcgggcgcttgaaaaggatatgccggtgcttgggatctgcaggggacttcagatcatgaatgccgcgctgggaggaaccctgtatcaggatttaggcgctcagaacggtaccaagacggaccatgatatgaaaaagccctatgaccgggccgcccacagcataaaccttgaaatgaaagcgcctcttttcggactgctgggacagaaaagtgtgggtgtgaacagcaggcatcatcaggcaatcaaggatctggcgccttctcttaagagcatggcgaccgcggaagacggaatcatagaagctgtttatgttcctgataaacggtttttctggggcctccaatggcacccggaacattggggcgacaacgaaacaagcgtaaaaatattacaggcctttgtcaacgcctgtaaaaactgagcatccataaaaaggggcaggataaaagggacggcagtttcatatatatagcagatcccatatgacagccatttcattaaaaactatatatggcagaaagtaaaaatattaccataaaaacaagtctgataatatatggtaaaaatattgtgaagcatttttttcattaacaatcccagtttatcataccagcgaaactgggatttgataaaaaagtgaacgtttatttactttgcgtttcttgcataagttttttgttttcaataaataaacatcctgtaaatactatttcataaagcaacataaataatgcaataatatcaggagagcatgtacatcctataattaaaacactgattgttacaattatcgaagagtacatataacttttggatttatagagccaaccaaaaggcagtaagtgaccgccgaaaatcattgctaaaaccataagcattttctctggtactgctgaatataccaagcagacaattaaatataaagtatttcattcaatttaaaaaggaagcctactttatttaatggattgtcattgcgcatatactcaaacgcttctgtcatttcctttaaagacatcatttttacctcctgaatattcacaactgcagacaatttgtcactttgttaatcaactccgcacaattaaatttgacacgcatactttcatacggctattcaccgttagaactccccaagttgttttattggcaggcgaagcaggtggtataaaaatagcttcttcaattatattgcttttgatttttcctaaattggttatgctataaccattttgggaaccatatccaaacatatttcttcctacaaatgctcctgctttacttccaaactctcctaatgtagatattgcaacagcatcaatcagctccgggtgcatatgtatataacaggcaagcacaagcatttctttctgtgggtgctgacatatatttgtgacaagtgacgctacgcgttttgcaagagaaatcacattttcctctttctttttcacaaaaatgctaaaagcagtagaataatttcccattgccccttgtctgtaacattttgtctgattacgaatatcggctgcaataaccaccttgtttgtattctcttccaacatcatctttgcaatcagccagtcatttacagtaacattatgttgtttgcataaagtcagtattttttctaactcctgattgcaaacggtgaaaatttcccgtttcattttgtgtttttgaatataggctctttcaaatgcgctatatttctcatacataacttgttgcccctcttttttccatcttctatttgcgtcgcctattatcaatttactgataagaggtaaatcgctgtttgagggaagatcgtttaagcattgaattaagcgttccggggcaaattgcggtattactccgttagcataatgctctgcaaattcttctgccagttgtagaagccctctgccgtcacacaaaagatggtgggcgataaaaagtatttgaaattcattttcctttggataaaccactacttttagcagacattcattcatgacattccacccacggacagatatttcctcataatcctgttgccacaaagcagcttcttcttttatcattacaggaatattcatataatcttgtatttgataataaaatctgccagtgtccgtttcctctgcaattaaactttgcagaaacgggtgcgctttttgaagagtgtctatgctttgttttagccgcccttcatcataattgctttctatttttgccataatcccaaagtgcatattaggacacataaaatgcgcacgttctgtatacacataatttttaaccgatttcatattttttctccaagtcattattttcccgcatagcaatatcattcaacaccttgtcctgatgtgcttcaatggctaacaagattaacaaaacagcaaatacggctcctgccaaaaacaaagtaattgaagaaagccaatgccaccctgccacccaaaataaaataccagttacaaataatacgccgatgagtttcatcatggtaagccccggttcaagcatattcagtttatatttatagcggttatcatagtccatattcttatgtttcatttgccgaacctctcttgttttcattgtggtataatttgaaactggcacatgcttctataagtaactgccttatttctccgggcgcaatgttcgttgtgttcgtagaaacaatcgttgctataccatgcgtaaatatccatgttttcacaaacacttccggttcaatcggaacaggaacgtgcttagccaaatcgtaaaggctttcaagtcttgttccgctatctgacatacatagtagatggaacagatttttttcattttgagccagttccacatactttagtcccatgcttaaaaaatagggggtttcggtatcaaaaggctgttggagcatggtttcttcaaatagtttttgcgttcttttgtaaacttcttccttcagttcttccatgttgcgaaaagcatgaaacactggttgagtagagcattttaattcactggcaagcaaacgtgcggttactttttcaaagccatattcttttgtcaactcaaatgctttttcaataatagcttctctgggtatcttaacttttggcggcataatattctccataaaataactaagttatatatcaatgttattatacactgcataaagattcttgtcaatttatctggctgatagttgacgctttggtgccaaaatgacgcccgaatttcctatagtgatataaaacaatatgggaaaatattgaaaatggtagaaaaatttataatatgagtgatacaatataatccaaatcgctaaatcaatatttgtgagggaataatgaagaaagcatattttaactggagcagcgggaaagattccgcgttagctctttataaagccttgcaatcgggaatatatgatgtgcaagcactgttcaccacaataaaaaaagatggctctaaaattgctatgcacgagattggtatagaactgctcaaacagcaagcagactctatcgggataccgttaacgattttggagtttgatttaactgctccatcagacgaatataaaaagtcgatggaaatgcacatagaaaaactcaaagagaaacagctcaacatcgcactttttggtgatttatacctggaaaacttgagaaatcaaagaattgataattgtaggcgacagggtattcaagccgagttcccattgtggaatagtaagccgagagaattgttgcaggaatttatatcattgggcttcaaaagcatcgtaacttgtgtagatggctctatgcttgacgaatcttttgttggtagagtaattgatgaatccttcctgaatgatttgcccgactatgtagacatttgtggtgaaaacggtgagtatcattcttttgtctttgatggaccaatattcaggaaaccggttgaatttgaaatagtaagccgatactacagagattatccaaatgagacaaatacaatgctgaacaggtattggtatcttgagcttagataatctcctccgcccaattccaatttaccaagcatgccttttgccaacatagcgaatcgcacggcggcaaacggtatatgtacaatcaacaatcacgatttacaaatcgttctaaatcccgtctcatgatggaaatattatatggtggttcctctttatcccaattccataagagacggtacattctttccatgcgcataagcgaccggaacgccaatacctgtaatgccccgtccaattttcccataattttaatctgaccgaatacagtcgcaaggataacctggtctgtctgcaaaagtgtctgatcacctttcagtccatgataagtttgtgctgcctgtgttttcagttcgtcatccgtctgctccggttcaggcggcaaataggttaagttccactcttttacgattaataattcagggaaatcagcaacacacattttgggccgtttccgtacagattcctctaaaaaatgcaatgtgtcattcccttcatcactgccaaaaggagcttcttcatcgccgcagtcataatacagttcttcagaaaaacaggcccggaaaacagggtggctggtcaggggatgtaaaccatattcctctgtatcaaagtaaaggtgatgcactgcgtcaaagtcctgcatgtccgtgtagccctttttttctttagaccgcacaagcttaaatgcctgcttctcacattcatcctctgtatcaaaatctttgatttcgtaacgtcctgttgtgccggtttttccccaattgattaccagttcacagcctgccgtttctatgcgccaaaacttgtccgatttttcatccgtatatcgtaatgcctgctgcatatcctgccctccaaatctgttcgcctccccatcggctcatggggatttgctgcgtacgctttctccgccttagatagtcttcagactcgcggcagagttcccaaaaaacctgttgttcatccgcaatctgcccgaagaagatattttcctcagtgcagactcaggttcctcatttgcatatcattatctcttcgttggaaccggatgtatcggttatttgcgatgacaccggatacccattttcatatcattgccacgaccacactgtcaggtaaagtcaaacaacgacagctgctctcccgccagcttatcctcaaagcggttcatataagcaaaaatccgattcgtattgttttcaatcccgtgctgcgcacaggctttcctgaccagccgcataagagaggcctggctgggggagggtatctcataggcattcccgtaggtttgtatgtatttttgcttcatgcccggaaaatgctcgtccagcttgcggtaaaaatactgcctgtcgccgtccctgagggtcactccaatcccgaaggtcagtattccataggtttttgcatggatgcagtaatccagtatgccgtggatattttcctccgtgtcattgataaagggaaggatgggcgtcatccagcagacggtgggtatgccttcctcccgcaggatatcaaggacctccgccctccgttttgtggtgcacacatgaggctccagcttccggcaaagcgcctcgtcatgggtggtaagcgttatctggaccacgcattttgtttttcggtgaatgcttttgagcaaatccagatcacgcagtatgagatcggattttgtctggatggcaaggccgaagccgtattcgtctatcagctccagacagcggcgggtcagtcccagctctttttccagagggatataaggatcgctcataccgcctgtcccaatcatacagcgttcccttttcctgcgcagggcaagctctaaaagctgtggcgcattctttttgatctcgatatcctcaaaaggccggtcgggatgaatctggtaacaggtgctcctggcatcgcagtaaatacagccgtgggagcagcccctgaacagattcatgccgtttccggctgaaagaattgattttacattcacttcaaacataaccgctccattccggccgcctgtttcttccccgggcaggcagccctcacggcttgtctacacccggaagcagctgcctccgacgaattcacgtacaatggaattattgggaaggttttcactgctcacgcccaggaaatattccaggaatttaagcaggcgctttgcttcaaaatattccggctgatccttcctcacgctgtaaagcaaaggctctgcaaactgcttcagcaccgccagttcgtaaatcagggcagagttgaacatggcgtcagcgctttcctggaatgggaaaatattttcctcctcccctctgcgcacggaggaccacatccgcagggtatgggtggcggaagcgcctcttgtcctggcatcccgcaccatgcggcggatcaggcggctgtccgtcgttgctatccggttatgatcgtccacattcaggctggtgagggcgctgatatatattttatatttgcttttcagaggaagcgaatgggaaagcctgtcgttcaggccgtggatgccttcaataaccagaatatcctccggcccgagctgcagataatcccctttgtattcacgaaggcctgttttaaagttaaaacggggcatttccacccgttttcccgccagcagatccgacatatcctgattgaatttttccacatcaatggcttccagacattcgaaattatagttgccctcttcgtccagcggcgtcttatcccggtctacgaaataatcgtccaccgcgatgggatgaggtatcaggccatgggttttcagctggatggcaagacgatgggaaaaggtggtctttcctgaggaggaaggccctgcaatcatgacgaatttcacatttccgcgcctgacgatatctcccgcaatttccgcaatcctgcgctcctgccgcgcttcctggaccaggatcatttccgccagatcgccctcgcagatcttgtcattgagatcccccacggtttctatctccatcttttctccccagtcgttggaacgaagaagcgtatggaacagcttttccctgggttcaaagggaaccagggtttccggttcgctcctgtcgggaagcatcagcatcagccccgctttataggggatcaggtcaaaatattgcagatatccggtatccggcaccatatagccgtagttatagtcataataaccgtccagacaatagacattgatataggagccgcgcctgtaacggaacagcctgaccttatcctccattccctgggcattgaaaatctcgattgcctcgtccgtgggataggcttttttactgatgggaagcctgcgttccaccagctcccacattcttttcctgacctgctccacgaagccggcctctatctggccgtcctcttccccgtcggcgcagattaccttttcagccagttctcccctgggaatgcagtaatagcccctgccgatggaaaattccacggaaaccttgcccgccctgggggagccggcgatatcactgatggccttgataagaagcatgatcgcactgcggatgtaggtgtcgtgtcccaccctgtccgccagcgtctgaaaggtaacggcagcatcacggtccaccgttttgtgaagctctttgatttttccgttggctatggcaagaataatcctgtgatcgtattctgcctgatgctcctgtgccagtttttcataggtcacaccgttttcatattccctgcatatcccgtttaccgttacttttaccataaatcgctcctattcataccagaagggttcctgctgcctggctgtcagcaaatgcagctgcggcagctccctgcttaaaaattccttcatataggggacaaaaatctgttccagcccgtaatgtcccgcatctatgatagtgattccctgttccagcgcatctataccatcatgatgaccgatatccccgctgataaaaacatcagcgcccgcgcgcactgcctgggagatataatccttcccggagccaggcaccacagccgccttccttattttctgttccgcctctccgaatacccggacagtttccagatcaaatatttccttcacataggccgcgcactcgcgcagcgtcatctcctccgggaaaatgcccacccggccgattccctccttggacagctcatcctcaaaggtagtttccaacaccgtcctgtccgccagcgccaggcggtccgccgcttcgtccgccattcccatcacatcaaaattggtatggcaggcatagtaggatatatcatttgcaatcagcttgataatccgctttcccgtaaaattctccgccgtaatccgcttcatcgcagaaaaaatcatggggtgatgggtcagaagcatatccgctcccgccagcaccgcctgatcgatgaccgcgtccgtggcgtccagcgcaatcataaccgattccacttctttgtccctgctccccacaagcagccccacattatcccagctttccgcaaaggaacgcggggaaagctcttccagcttcgccattacctcactgcatttcatgcgcccttctccttatgtttgccgccgcatcccccgatacggcttacctggccgggacggttcatttcattatgccaatcagctgctccagcaattgcccctccttcgcaagctgtgcaaggcgtcccgccgttttttctttttccggcgccccagcctccccggcagatgcgctgtctatcccggcacttatctgccggttcttcctgaggctctcctttaaatattccagcagcacaggatttttctccagaatcaggcgggagccgaaaatatccgccgccctttcccattcatccgatgaaagcagtccctgggacttacattcctccagaaagcgtttttcctgcgcctccaacgttttctggcaaaaaccttccggcgggttctgcaggttaacagcctttataacggtatagaatttgccctcttcccagatcatattctcttccgtaataaaatatccgttctttttcaaagcctcccttaccagccaggcctccgactggggctggagaatggcccagcgcatctgtgcaagcttctcgcggccctcctccatgatcttcaccatgaggcggccgcccattcccgcagccagaagcgtatccgcttccggccttcccccgcgacagggaaggccggaaattccgtcggaaagcctcacgtctatgtatgcagcaagcccgaattcctccacgtgctccctggccctttccagagggccttcattaacatccatggcaaacacgcgggggcagacgccctcccggatcaggtataccgccacatacccatggtcacatcccacatccgccgggatacttcctttttccaccatggatgcgaccatatgaagtctttttgacaattccatattcttttttccttaatccagataatccttcagcttgcggctgcggctgggatggcggagcttgcgcagcgccttggcttcaatctggcggatacgctcacgggttacgttgaactccttgcctacctcttccagcgtccttgcacggccgtcgtccaggccgaaacgcaggcgcagcaccttctgctctctttccgtcagggtgcccaggacctcattcagctgttccttcagcagggagaatgctgccgcatccgccggtaccggcacattatcatcctggatgaaatcgcccaggtggctgtcttcctcctcaccgataggggtttccagggatacaggctcctgggaaatcttgaggatttcacgcactctctccaccggcatgctcatttcttcagcaatttcctccggagtaggttcacgccccagttcctgcagcagctgtctgctcacgcggatcagcttgttgatcgtctctaccatatggaccgggatacggatggttctcgcctgatccgcaatggctcttgtgatcgcctggcggatccaccaggtagcataggtggagaatttataacccttagtataatcgaatttttccacagccttaatcagacccagatttccttcctggatcagatccaggaacagcatgccccttcccacatatctcttggcaatgctgaccaccagacgcaggtttgcttccgccagacgctttttggcttcctcatcccccacttccatcctctgggccaggtcgatttcctcctccgcggaaagcaggggcaccttgccgatttccttcaggtacatacgcaccggatcttcaatgctgatgccatcgggaacggagaggtcgatactctccatatccacttcttcctcttcggacaggataatttcctcatcgggaatatcgtcatcatcctcggtgatacgcagtacatccacgttgctctgctccagcagctccagcagcttgtcaaactgatcctcattcagctgcagatccgcaaagtaatcgctgatctcctggtattccagaatattttttttctttctggcaacgccgataagtcctcttactctttccagaaacttcgcttccgcggccgctctttcttccggggtcatttccgcttcgttctgatttgttgtttttttcgtctcatcagctttttcctgtgtctttttgcccattcttagtccatccttcctgcgcatgttaatattgttatccttaattcagggaaatatgcgttttgctaagttcttccaatgccttttttccttcaatgacgcggtttaatgcctccacatcagttcccagacggctcgtattatattcatagctgattctttttacagaaaccaggatatcgtgaaatgctttttctttttcctgtattgtctccggttccatcagccttgtgttaaaaagtgacgccacctctctctgctcctcctcatcggggaacaggcttatgatggatgccgcgttgatttcgcccttttcaagccctgcgaacagcctttcggccacccgcacataaagctcttccgtaaagtcctcaggtccgataaaccgctcgatttttttatataactgcggttcctccaccagccaggtaagcagaagcctctgggtctttttgctgttttcctccggggtggtttttttatggattcccgatttgggccgttccacgggtttggcaagccctgtctgggctgcaatgctgcccaccagcttcctcaggttttcgaagccgatatggtatttctccgccaccgcttcgatataattctcccgctccacctcttcggaaaaatcacacagctttctggcgatttccctgtggaacctggtcttgtcctccggatcagaaaggttgtactccttctccagcatcctgatctcaaaaagaaagctgttttccgcgtggtcgatgcgttcctggaacgcttccttccccagatttttcatgaattcatccggatccttgtacggctccagactgataatcttcccggtaagccccgcctccttcagtatgccgatggcccgcagcgccgctttcacgcccgcgccgtcgctgtcgtaggaaagcagaacctccttcgtataccgcttcagcagactggcctgtcccagtgtaaacgcggtgccaagagacgccaccgcctgatcaaagcccgcctgatgcatggaaataacgtccatatagccctcgcagagaatgatattccccttacgcgaggtccttgcaaaattcaggccgtaaagattcctgcttttgtcaaagatcggcgtttcgggcgagtttaagtacttcggggttccatcccccatcaccctgccgccgaagccgataacccggtggttgatatcctcaataggaaaaatcacccggttccagaacttgtcgtacatgccgtgtttttcatccacgttgcacagcccggcctcctttatcagctccgggggataccccttgctgcgcagatactgtaccaggtcattgctggtcttattggcaaagcccagcccgaatttctttatcgtctcatctgagagctgcctgtccctcagatacctgtaccctatttcaccctgtctggcgcgaagctgaaaataaaaatatttcgccgcctccttattgatttccagcagcttgctccgcttgctttccgccttcttcgcctcttcggaatattcgatttccggcagattcacgccggcgcggtccgccagcattttcaccgcctccggaaacgtgtaattctcatattcctggataaaggtatatacattcccgcccgcgccgcagccgaagcaataatacatctgcttgccgggcgaaacggaaaaggaaggcgacttctcattgtggaatgggcacaggccgaaataattggcgccctttttctgaaggcgcacatagcctgaaatcacatccacaatatcatttttcatcctgacttcttctatcagttcatccggataatacatgccttctctcacctcaatctgtaaggctcccggttccatcagaaccggaatccgttgattacttcaccgtccagcacttgggaatatagatttcctcatactgtgcaatggcgaaacggtccgtcattgcccctatatagtcacagcaaatcctttcctttgcttctcccctctccatcaaaaccagcagttcgccggatattttatcaatatgatggagataataatcgtagagcgtttccaccagcagctcggccttgccttcctcgcttttggcctgctggttcgtgtaaaccctctcaaacataaatgaacgcagttttttcatagcgtcctccaccggaggggacatgcatatgtcgttctttccgaagctgttggtcacaatatcatggataaaatgatccagccgctcgcccgtggtcctgcccgccacctcctgcacctgcttcggaatatcctcctccctcaggatacccgcccgtatggcgtcgtcgcagtcatggtggatataggcgattttatcagacaatctgacgattttcccttccagcgtagccggattgcctttggtctgatgattacggatgccgtccctgacctcaaaggtgagattcagcccctggccgtccttctccaggatatccacgcagcgcacgctctgttcgctgtgctcaaagccatagggacagactttgtccagcgcacgctctcccgcatggccgaagggcgtgtgccccaaatcatggcccagtgcaatagcttccaccagatcctcgttcagcctcagcgccttggcaatcgtccttgcattctgggacacctccagggtatgggtcagcctcgtcctgtaatgatctccttgcggagcgagaaagacctgggtcttgtccttcagtcttcggaaggctttacagtgcaggatcctgtcacggtcccgctggaacacgggcctgatatcacagggctcctcatccctcagccttcccagggaattcttgctcagagaagcataggggcttaaataaacctcctcccacttctccagattctcccgaattgttgtcatccgtcacctttccgccatacggcagccacgaatatatggcattataatgcctgtttccgacacagtacgtcaatcaaaaatatgctcactatctttatattctgcgccgattcccggaatccttttatttttttcaaaaaaattattttttgatggcaaaaaaggaagagaagcgctggcctggctctctttttattctgcgggaacgcgaaatcagaccggacactctccttttatcctcttatttatgcctgtgtgaatcccggtaaaacaatactgtcatcaccagctgcagcgctcccagcaaaaggaaggtgccagacagcccaatccgctccgccgccgcgcctgctgccggaaacagcagtatcataataacggaaaacagcatactgcccacagaaatcagcgttgccctctggcctgatgggatcagccggttcagggaaatggactgtatcggatacagcagggcgttggaaaagcatgctgccacaaacaaaaccacggacacgggcagcctgtgcaggaagaacccggcaagccccgccgcaatcaccagcgcagccgcatactgtgtcctttccccggctttcccgtataccttttcactggccagcgcgccaaggcaggaggccaggccgcccaacagcatgatcacgctgatttccaccttatttagtcccatatcataaaaatactgctggctgtagaaaaacagtacggtataaaaagcaaaaaccatctcaaaatacagcattatcctgcgtatttccctgttttccgccagaatgcggaagcttgtgacaaaatgctgctttatcatgccgccgctttttcttatttcctgcgttatttccggctccttcatcagcacagccggcagcaaggccagcagggcgattataacagatgcgccatagcaccagacataggatctttctgccaggataccgcccgccaccgtggcaatggactgtgagatttcaatgagcagattgattctgccgttcaccttcaggtactccggctcccgcccgcactgcttcatgctgtcataaaccagagcttcctccgaaccggaattcaggttatttcccagtgcctgaatgacaaaggacagggcaaagccccagaatttacctgaaagcagcatcaggatacaggaaatggccgtgcacagccgtccccagaccacagtcctcttgcgccccagcaaatccgccgccgcgccggagggaatttcacaaatcatgcttgtgatgtggtacactccctccagtatgcctatctgccacaggttcatccccttaaaggccagatacagcacccagaccgaggtggacatgtcaagattcttaagaaaggtaaaaatataatccaaagggatatttctgtaaatattccagcgttctgtatgcttcttcccagatttattactgttcattttcgtaactccttttttatggcagccatcggtccaatccgaatccggactgctctttttacttaaaaacaggcgcaaaaaaaccaggagcatgcttccacatgattcccggttcatatcggagttactgcttaaacggaaccgccagacgcaacagtcccttaactacagacaggccctgccacagtctctgtgtatgtccgtttccctgaaaaagggcgcagtatccccgtaaagcaaaaataatcctgctttcgtccgaccgctgctgctgtaaaccggcacatatcccaaactgaacatgtctgtctccttcctgaataattatggttctaacttatcacatacgttcccggatgtcaaacttgtttcttccggctttgttttctccgtccctgttccttccggcttttcgggatattccgtaacagcccggttatcctcaacgttacaatagttctgaagaatccgggcggcctctcttttgatttcctcacgcagccgctccggcgcaagcacctccacgctgctgccgaagctgagcacccattccagcaaaacaggatagttggtaaagcccagattttccaccaaaagtgtgccgtcctcctgctccgtaaagctggatggtccgtattcctcaataagacggaacttcaccttccctgaaaatctggcccgcagcatgatttcatcggaaaaccagtattcgctgtccagcttttcctccggtacttcccgcggcgcaaaggcttcctcttttcccgcaagctcccacagacggttcagcttgaacatgcggaaatcctccctctgcctgcagtagcccagcagataccaggaagaccactgaaaagccacccggtaaggctccaccagacggcggcccgtcccttttctgtaataataggtaaattccaccagcctgcgctcctggattgcagccttcaggaccgcaattttttccgaaagactgtccctgtaatgggaggccagattgatggttaccgcttctgccgcagcaggcatatttccctgcacgatgtggaatttctccttcaggcgctcctccatggggtttttcatcacgctgtccatgccgcggattcctgccagcagcgcttctctctcctttgcggttaaaaaggaattatccattttaaagcccggggccagggaaatcccgccgccgaagccctgttccgtaacgattgggatccccgcctggcacagcgcctccagatccctgctgatggtcctcctggaaacctccagcttttcagaaagcattggcgctgttactttatcctgctgcagcaggatggtgagaatggccataagccggtctattttcatccggtcaatcctttctattcttctgttcgttcagataatattccaccagcgtatgggatacgcttccggccggatgcaccattttgagagcctgggaaacaggcacccacacggcctcgtctacttccccggacagaaccagctcccgctttttcgcttctgcgatgaagcctatcatgagcatgtctttcttaccgaaccaataggttcccgtcatccgaagccgttccaccggaacgccgatttcctcctctacctcgcgcatagctgtggtctccgcattttcaccgggcttcatgtagccggaaacaagattataataggtatccgatatatatccctggcggagcagggccgcttcgccgtactcgtttaccaccagcgcaatgatacaggtggaaaacatgtcaaacagcggctttttgcagcgggtacaatagggcaccagcccttcatccccgatttcttttggcgtcagtgcggttccacagtcagggcagtaggtaaatttcataatatttttcctttccagaataaaatgcaggcagcgccgtttttcagcgtccggcgctgcctgcgtgctttagtaattatagcactggttttcctgtaatggaattatatttctcaactattgtatttcgcagttattcggcagcttcgggcatttgtccgaaatccacaaggaagctttctccaagctgccggaaatcattgctcatttttccgctctgctcaggcatagcgaccacatagaacgtcatttccacctgtcccgccgcttccggcagcatatctcccaaaaggcgcatatacccctttcttgtgcttccgccgccgaaataattcatgtagaaaggatattcctttccgctttcatccctcgcaatcaccttcatatcataccgggaggcgtctttatcatccgccgaaaaattaatccgctgctccaggtcattgcttgtgaactcatccaatgtgacagttacgccattgggaagggtaaacgtccggtttaaagcgatatgccgtgtatccttcatcagggcggaggcgtccgctgtaaaagaaaaatcccatttgcccttgatattttcccatatatccagctgacggaatgagatatctatggctgtttttcccaccaaatcaacgttttcacagttatagcacatttctatgccgacaattgtctgttcctcatccagatattttaagcctcctccgccgcccgcaagcacacgtctgccgttaacctttatggaggcaatgggagaaattgcgctgatgtcaagcggctgcccgtcctctctgcgcaccgtcacattgacccacacttccgactctgtcaccacaacctcatgcagggtcaccgcatagccgccatccatggctgtggtgttgaccacctctttatagtccgccagatcctcctgcagccccagcgcatttccgattgtccactgcagctgctccagcgccgcatgaacctcactgcttgatgcggcgattcctatcacaattacagctgatgccgcacagactgccatttttaaggaacgtcctctttttatggatttattccggcattttcctcttccggccgcttcactttccctggtcctcagcctcttttggaaggccgcctcatacttttcaacctctttccgggaaagctcctgttcctccgttttagaaaaatccgtaacaatatcatttgccatatcatatatttttttattcatatgccttctcctcatctgccgctgctttccgcaaaacgccgcattttccgttttcccctggataccttgttgtatacagcttcccgcggaatccccatctgtgcgctgacggtttccacgtcctgctcctgcaggaacagccttgtaaaaacttctctgtccttcggcttcaggcaggctaacagagcctttgtttcttcggaaagctcctgttccaccagctgccgcaggttttcatcctcttcggccagctccacctcttccagcgctgtctggtcaggctgtttgccgtatttgcgcaggtagtcgatggcgtggaatctggccacgcccgccgcccagcttttgaagctgctcctttccggatcataagagccgatattattccatatgccgaaaaaaatatcattcatgcactcgtctatcctgtccggcatacagtacagtctttttcccacaatggaagcaagcagccctccgtaccgttccatcacatatctgattccctcttcccggcgcttttttatcagggaaataaaattatcttcatttgctttcatacaccactccatcacaaaccggaaataaagtctgcagcctctctccggttttctcctttcacttattaattcggagggaggagggcaggatctatccgtttatgaaatttttttaatatgccctgctgctggtttctctggcaaaaaggccgcctgggagtcaggcagaaaggcatcagtattgtatcacgggcaggcggcttcgtctatggagttggcggctgcatggcgccaccggcggtagtgaacagcgacggacggaatacatgctgcggcggctgaagtccaagttcgatataaatcataacggatgcgggaatgtgttttcactgtttttactaatagtgcttgttgttttttcattcaactgttatactgttatggatggggagatatggaatattaatgtaaagggaggggcatatgagaagagccggcattacggaagcggaaataattcagctgacgctggaaaatgtccgcagcttttatcacaggaacccggaagttaccaccgcgcctatggcggataatttcatgtggattggttccaatgattttcaatggtgtgaagggctggagaatttccggagaactatggaaaaagaatatgaagaaccgcctgtgttgatatcggatgaagaataccacctgctttttcatgaccgcaatgtatgggtggtctgcggccgttacaggatcacctcggtcatggaggacggcaccgccatacatgcccatgtacggggcacctatgtatggcgcatgatcaacggggaactgaagctcgcccatgtccacggatcccatgcccaggacattcctttaaaccgcattgtcacgatgccggaaccgcttaccgcggacatggattattttgattatctgaagcgcatggactctattacttcagatgtaaacaaaattgccttccgggatacgaataagaattaccggtatctgtttccctcggacattctttacctgaaagccgccgcccagtggtccattgtacataccaaaacggaaacctttcaggtgtggggccttctggctgactatgaaaaaagccttccatattctttccggcgcattcataaaagctatctggtcaacagcctttacgttgacagcattcaccggtataaggcagttttgagggacggccaggagctgcccatcggcaaagaacgctacatggatctgaagcattatctgcagcatgcggtttaaggcttcccctgcggcgaaggcctgggcgctgtcagtccaattatctttaaggttatgaaagaggcttcctggaatggatgaaaaaatagaagaaattgcgagcaaggcaagggaaatcctcaggaaaataccttttgccgaaaaagaacagattgattttcagacggtggagtatggagatcctacagtcacttatgagagctccggctgtggcttcgtgcaggtggtaaatgaacgggggcaggaaagacgcagcgtcatagccggcagctttgaggaaatggtaaactatttcgtagacagtgcgattacagactatgcataccgctatgagcttgcccaccgccgccgctttgaatcaaacctccgtcagacggatgaagtccgtgaggcctgttatcattatattgatcccgggaaaaaatgtatccgcagggattatgacgatacgccccatatttatctggatctttttgctgcctatcgcagtatctgtttaaaatacagggaggaaaacgttatttcctgtcagtcgcttaaggatgacattgattatattgccgaccggaaatatacggatactcccggcggcggtatgtacagtctgaaggcttccatggaaaaggtgagggagcggacagaacgaatcagcgcaaacagcagcgagcttagggaggctttttggcagtatgaaaaatattaccggcttctgaaggaaatgaaatgaatgcaaatgcaggaatggttgaaggaagcttcaaatcagcaggccggcatcgaatatcatttattctatttcctgccggccggatagttatctgtttaaaatctgctgcagcatatcccggctgacaaacggggcaaggggaatgatatcctgcatgttttttatgttatgttggcaggctattaccattttatccacaatatccctgttcacaaagggggctatgctcactatatcttccagggtgagattttgatctgcaaaaagctgtgctgcctggcttgccgttttcctgctgataaagggtactatggaaacgagctcctgtattgatgtgaattttcccagattttcctctaccagctcatccatcagcttcctttcaataaagggtgcaattaaaatgagcatttccacctgggtcaaaagctctttgtggttaccagccatttccgttatcatttctcttcctacgaatggcgcaagataaatgatatcttcaaaactttctattttaatcttatattttcttacatcggatggttttacaatcccctccagttcctgtaattcctttacactgatttcctgctcctgaggatgcatcagcatttctacgcacttcgccttgtcctgataatccagcagttcatcaacggttatgtgaaagagttctgcaagttctgtcattctggatatatccggcatagtttcatttctttcccaactactgacagcctggaagctgatacccattttctccgcaagctccatctgcgtcatatcggcggcaatcctgtatttcttaatctgttttccaactcgggctaagtcaaacatttcttgtcctcctggactttttcctttgattatactgtttttcgggtgggcgtgaaagcaagaagtgcttgaaagggatgcagggatgggttcaagcggcgcttgaaaggaggaagatggatagcgggttaaaagattatttgaggtggtatgatccttgacctgttgtggcctatgaatatgtcacaaagcaactatttcaatccataaggccgtataagcctcgacgcgacggatccggtggtcatgtaggacactgctattatttcaatccacgaggccgtataagcctcgactggaggcgttgagcgcctgtgggcgaaagttaaaatttcaatccacgaggccgtataagcctcgaccgcggatccaatcgctgaagcttgggaggatggatttcaatccacgaggccgtataagcctcgacgtttataatggagtcattgaaggtgattatctcatttcaatccacgaggccacataagcctcgacaggaaattatgaatatatcgtcatatcgaatgatttcaatccacgaggccacataagcctcgacgaaatagaacatcatctaatccatctttattatcatttcaatccacgaggccacataagcctcgacaaaacgggttttgccgtatttatgataaggcgagaatttcaatccacgaggccacataagcctcgacgggctacatatgacggaagacgaatacaaaatacatttcaatccacgaggccacataagcctcgactttttttcccggctatttgcaagccaagaatccatatttcaatccacgaggccacataagcctcgacagcaaaaacatacaacaaatattttcaaaccactatctcaacgacactattatacaacttctctaaaaatttatcactatataattacaatatatttaccaaacccattactatttacaaaaaactggtgcgaatcccccggtaaattcatgtgcacttccgattcgcaccccctccccttccttactgccgcatcctttctctcctcctcgctgcttctttcaaccatcagccgtacacttctcattcctcgttacacatttttcatcccatcacagaatttctttttccgctctgataaacactgcccaatcaatgcattcaatcatctcaacccgggaaaaacctgcattttccaacaattccatttcatgctctgccgtaagcggcgtatcaaaatgcacgaacacctcctctccgatcccctctttttcccgcttcgaatcacacagctccatcagaagtttttcctcgtcctcacagcatgcaatatagtcagcctctatgaaaatccctccatttttcagcgtatcatatattttccggtacagctccagcttcttctccggtttaaaatgatgaagggattcaaaggaaacagccatatcataagcttccttaccgaaatcatacctgaagtaatccgccctgatcgtatgtacctgcggatgcttggcggacagcctgcccagcatatcctccgacagatctatccccgtcacctccagtttcggacgcttctgcaggatttcatccagttcaaggcctgtaccgcagcccaaatccaaaagcttctccacatgctccggaaccaatgtccccatatatttatatgccctgctccacaaagacatatgttcctcatatccgtccagacgcgccctgaaaaaagcagccatttcctccagcccggtgtccttcacctcttccgtccagctccgaagctgctgcatatactctgccgtattttctctgattacaattttcttttccataaataaaaaacctcccaaaccttttatccgctgtccgtccacccgatatttccatcaaaaaggaggaggaaatcctctctccccctcctcacaccgcttcagcaatgcaacctacgacaaaaggatgacaaccccaaccagtctttttcgtatgaagataacccggaacagctttccttttccatcatacctgccgccccgcaaaaaagacacctcatcctctgttcataaaaaaaccggcggaaatccacctgcatttattttcacattttataacgcttccttctccgccctctccacataccaatccaacaatccataaagccagctaccaagctccctgcaggaacagcctgcctccctggctttttccgtattcaggctgtagctgtccgccccattatagggagcctcttccccgtcatcctcaagccggggcaccgcgccagtcttttttcccacatattctaaaatttcccttacggaaaccgttcccccgcagcaggcattcaccggcccggttacatccttatccgcaagggacgccaggaaacgcccggcatcctccgagcctataaagctcatctggctatctggattatccacatacatgggaatcccttttacggcatgccgcacataaaaatacagccgttccgtgtaatcatccttccctatgacgaaggggaaacgaaccataaccgcattctgccggggataattatgcaccaatgcgcactccgcgcttcttttcccctcatcataggtaacatcagttctgttgcaccaaagcagcgccttctgctccggccggaaagccgtttcctgtatatccgggcaaagctcatataccgaagcagaagacaccatgacgtaccttccgcaccgaatggcatccaacgctgtttttacatccatagagcaatatgccaaatcatcataaaccacatcaaaccaaacatcccggaacgcctctttcatagcgttcccatcggtccgctccacaataatacgttccaccctgctgccgaagggatccgccgtctgcccccttgttgcaattgttacctcatgtccgtcctccagcaaagcattcaccagatggacgccgaaaaaacgcgttcccccaagaaccagtattttcattggtttccttctccttcctgcctcttttccagccattcccagaactcctccacaggcaggggcctggaataaaaatagccctgcaccatatcgcagcggacacgtttcaggaacgcaatctgttcctgtttttcaattccctccgccacaatctgcactcccagccgccgtccaagctcagtcaggcatatcagcacatcctctgcttttggttgggatatatccaggaaaaaacgtctgtccagcttgattgtatccacgtcaaactcacgcagtagccccagcgaagaatagccggagccaaaatcgtccagagagcacttaaaacccagcctgtgcattctgcggatgcattttcccacaaattcaatcccctgatcatcaaaaaatatcgattccgtcagctccagctccagaatcccgtccgggatatggtatttgtccgcaatctcagaaaactgccgcaggaaatccggatccttgaaatgctgccgcgacagattcactgaaacaggaaaaatcgctttcccctcctgcatccgacgcgccaaaagctcacataccttttcaaaaatataacggtccagcttacaaatactcccgtttttctctaatacgggaataaaatccgagggaaaaatcatacctctctgcggattcctccagcgcaccagcgcttcagcgcctgccgttttaccatccgaaagcctgaccttaggctgaagatataccagaaactcgcccctgtcaagcgctccctggaacaatgcggtcaattcatgctcctgacgcaggctctgcatgaatctgttgtcataaaatacacattctcccagcgtgtgatcctgctgccaaagacaggctgtcttggcacgatcctggatgatcgtaatatccatctgcggctcctcaaccacatatgccccctgacggaaggccagacaataagccgtgtccgcctctctttttttattaaaagaattgatatcctccgttatcccctcaagccgcgccctgacagcagactccttgctttccctcaggcacaggtagtagctgtcctcctcccctctgcctgccagctctccctgaaaaatattccgttccagcacacgcatgcaataccgaagcgtatcgtcccccgccctgcttccaaagctttcattaatcagcttaaaattccgaatgttgagaaataccacagtataccggtccggcggcgcattttccagcagcgccatcagcctgagcctgaaagccatactgctcatccctcccgtcaccgcgtccacaaacgcaattttttccagttgtttccggttgtttttctgaatataaagcagacaaagcaggaaaaaaagaaacaagacgattgtccctgccacaatgcagaaggtctgcataatatatttatccgtctcataggatatgagatccgcagggacaagggtgagcaggacccacccataagatttcagtgtgttataggaaagaaccagctgcgtcccgtcaactgcgacaaatgaaaaaacaccgtcgcagcctatcttcatattttcctgcatctgataaattttctgcgccgtttcaccttccgactcttttttgaaaatatcatccagctgcagaaaaggctccagctccgtaggagaaataatgactttcccgccctcatccgcaatacaggtgagcccctggccgccgaagctttcagcctgtatcatcctctgcatattttctttttcccgggaaccggccagcgccccgaccaccttttcgccctcatagagaggaacagagcacactattgtctgaccgtccagaaaggaaacacctcttctgcctgcaagggaatccctgattcccggcagctcccgcagattttccacagcttccgaagttgaaaccactgttccgtccataccgatgaccgccatgaaatcaagatccaggatggctgattttctctgcagataatccctcactgcctcatttccccggtcttgcatccgtatcaggctgtctccaaccaattccagttcatcgctgttgtttttcagccgcccatcaatatctgccgccagctgcgccgccacatcctttacataggactgcgtgcttctgtccattgccgcatgtaatcccactgcgctgcccacagttgctgccgcaattaccccaataagaacagccagtatcaaaaactgaattcccgttttccttttcatgacgtatgccgccggccctccggcgtttttttcgtttttcatctaaataaaaaactcctttttctccgttacaacacaggaacatgtcaaaatacgcctatttttctatattttaatagcaaatgtaaccatcggcaataatgaatctgtgtacgtttacatatagcttgagaaaaaactttatggtatgctatcaatataaccatgtgccaggagaaaacatgcaggagaagaaaactttattctattttttatatgacagtttaaaacagcagattctttccggctgccgtcagtacggcagcccgcttccctcccttagtcggctgtgcgagacctatcatgtggggcggcgcacggccagggatgttctggatgcactccgccatgagggcctgatccatacggaggaacgcaaaaccgcggtcgtcatctatcgccagccggattccccggaagaaaataccgctctgcgtttcgttctgcagcggaaatcctcccttatcgaggtttatgaaacaatggagctgctgatacccgccctgctcaccttttccgcagttcactgctgtacaggtgagccgcacagcctcagggatctggagcactacagccttttccaaaaatatgcgaaaaaaaagaaacccaacgatgatctgggaatcccttctgtttttttccatgatttgctgaaggaaaccggaagcctgcttttgaacgacctttatgcaagtcttgaggtttatacccgggttcccctgattctgatgaaggaacagttccccgcatacaaaatcagttcaaatgactataaaatcctttcatcgatccctttaatcctggagagcggccggcaggaagatgtcgcatccgtctttcgggagctttacagccatgccacggtccttgtgcgcctttatctggacagcctttcttcccgttttccggatatccccgatgatcctaaagccgtctatacctggcaggcacaaatgggacgcgatcatttttacatgcagcttgccagggcgctcatagataaaatcggcaccggagcctgtccgcccgggacacgcctcccctccgaagccgccctgtcaaaaagctgccgggtgtccctttccacggtacgcaaggcgctttccacgctaaatgacctgggctttgcccgtacggaaaacggaaaaggcaccgtaatatgccttcaggataacgaaaccgcctttcagtgcataaaaaacccttcctaccgccgagacaccttactatatttaagcgccgcacagttcatggccattgccgtccgccccgcggcacgcctcgccttcccccggctgaatcgggaagtgcaggcacagcttggccgggaaatttccctacccggcagcaacccgctggcctgcattttccgctgtatcatggataacctcaccctgcggccgctgaaaagcatcctggctgaaacggatcagctactgctttggggatattatttcgccttttttgaaaaagggaccgaaagcagtacgccgctgcatcagcttgccgcggaggcctttcacctcctgcagcagaacgacgcggagggcttttccagactgctctccctttgctactgccatatcctgcagtttgtacgtgacttcatgataagcggcgggctgacggaagcgaagaaaattatggttccctatcctgaggaagggtaaaatatcgttcctattctgagaaagatcgatgccagtccttccttcccagctaaacagtgcggaccatcacgaggcagggattccattcatcccagtaaagcgggaagcattccagcttgcagaagcccaggctttcataaaacatccgggtcctgtcatacacctcaaagtaacctgcctccaccgttttcacctggataaaccgatagcccttttccttcgcatatttatggaattcgtcaaaaagctgatgtccgattccttttctatgatattccttaagaatccccatcacacaaatttcagccgtataaggccctgtttccttcaatgcaataaatccaaccggcttaccgtcctcaatcgccgcccagtagggcagttcccggctgagcctgatatattcatccctgctttccttgatgccgaaccactccggcaggctgcataaaacattttccgtaatcttttctttttcatccgcttccgtaattaccttaatcattatcccgtccctcttccattaacagtccagacgggcgaactattcacacttcgccctgcccaggaaatcaaatatcctgttattaacctctatcgctttttccataggcatatgcggcctgtgcccgcagccctccacaatcattatctcagcctggggacagtgtgtccggattgcctccagattccgttttgtggcaaagccatcgttttctccggcaataagtaacataggcatagtaatacgcccccactcttcgtccgtcagtgaaggatgcaggcgccagtccttcacctcctgcctgcagtactcctgccagttgcccctatgggcctgggcgtgcaggcatttcaccttttcaatgaaatcggtctgtcccctttcctccaacgcctccggctcaaaatcctccgctcccgcatcgtcaactacgccgccgtttccgatagctgttactgtttttatccgctccggatgccgggccgccatatagtaggcgacaccgccgcccgtgctgtacccgataagatgtatccgctcaattccgcaacggtcaagaaaccgtatcatatcctccgctatcaccgcagaatcccattccagactttcgcacatggtcctgccatgccccctgaaatccggataaaagcagcggtatcccgccgcataaaaaggctggagctgtccgctgaaggccagaatccccctgctgtagccgctgtgcagaaacagcaccggctccccatatcctatctcttcataaaataactgcaattctcccaaatcaatatatggcatttcccttcccccgtttcttccttacttcacgcctttgtctcgtcctgctgcctatagctgttttataaacccttctatctccgcgttcacctgccctgcgttgtccccattggaaaaatgcgccgcatccgcaatcatatgcagcggatagcctgtcttttccgcccaggctctacaataggccttcaccttacccgtggtgtcatattcccctgccaggatgagcaccggacaggaaaacctcatgtctttattttcatccagaaattttccgtaggcgatatccatctgctctattatctgcgcctttgtcaggggccgcagcatttccagcattttattccgggaataggccgtcctggagacggattttgccatgctgcttctgagcaggccctcagggaaccattttgccaccggcgccgcctgcttcagccaccagatatccgattttgaataataaccggtgccgaagggcgtggtgtccaacgcgataaacccctccgttttttcaggatatctgcaggcaaattcctggctgggatagcctcccattgacatgcccaccagaaccgctttccctattccctcacgctccagtatctcattcagatcctgcgcacaatgcccataggaaaaatcccggtatggccgggaaatgccatgcagcgggacatcccaggtaatcagggtacaggcgctccgaaaatattccacctgcttttcaaacatggaatgattggcggtcagcccatgggtgaatacgatgcattttgccccgggcgctgcatttttttcaatccagtaaaacacgctccctctccctgttttcatctccttcttttccaatccccgtttcctcccatttttccgggctggcttggcttcttttttccgcagccaagccagcccgcgccctgtcgccctatccgcatacaccttccaggtattttccaatccgctccaccggattgacggcctttggaaaatcacacagcagctccagctcatataccagggaatacatggcaatccgaacatcgctcttgggataagcgaacagctcgggcgcatatttccttacccaggtcatcagaaaacggtaatcctccggcagcgtcagaggatcgtcctcctcattggcatagttaaaaggatggatttccatccgtttccacacatgcaccgcataatccgcaggcgccgcctccagcatttcaaaatctatcataaaaagctttccgtcttctgtaacaatcagattgtcaaaatgaagatccggatttacaaggaacaatgcttcctcctgcaaaagtcctgcattcgccctgataaattccgcagcccgccttcccaacccctccggaatgccctgatttaagcggagcttccccaacgccgtctccatcctcccaagaagctttttcccccagtttctgcaggagtcaaacaagggcatcccttccggaagcgcagtccggttcagttccctgttgatttccgcaatgcaacggaccatatcctccctcttctcatccgtcatatgcctccatgcgcgaaacaggccttctccttttatccgttccagaaccaggtaatcctccccggcccccagcagcttcggcgcataggagggggcaatgttcccatagaaccaggattccttttgaaagcctgcgcctcccggctccgtaaatattttgaccactgcgtcttctgtaagaaaaagcgcattggtaaacccggactttgactgctgcaaaccgtcagccgaaagcccgtgctttcgcaaaatttcctccgcccccatactttcctccgccctcattccttctctctttcctttcacgtcgcctcaggtggaaggcttcttatataaaccacatttccatccggatcatagaaactcatgtttcttgcgccccatggccgtgtctccggtttttccagaatcctcactccctgctttacaagcctggcatattcccggaccacatcatccgaggtaaaagccaggctcatcttctgtacgccattctcccggctttccccgtcattgtaaaccgtaagcatggtttccctggaaagaatggtctgatgaaccgtgtcctcgctcccgttatccacgcccagaagcattttgtaaaaatctgccagccttaccacgtcatccgtcagcaggcatacctcacccaaagtcattttaacccctccatgttttgccgtaaaaaatgcgctccctcttcggtcagagaaggttcttccgccgtataataaaaatcctttttactgcagcccgctcttccgcctcctgcacaggcgcaggcacaggcacaccccgcacaggcacaggcgcatccgccatgtcccccatgtccgccgggacgccttccccggccccagaatccccggccgttggcataccagtcctttccccaggccgcctgatagcctatgtagcctgtacacaggagaatgaaaataattgcggcgggatccagggatttcttttccccggggctgtccgacaccggcgcccattccaccatattggcatccctgaatgtctccttgtcacaataaaccttcatatgccgacgctccccttcttttaacccgccctcccagacgtagaagccgccttcctttctgtccgcattggtttccatcacataggtcccatcctcccagacaaaaagataatgttccaccgcaatctcattaaaccatcctggcataaaatcataaaagggcaggccgccggcctttttatttctgcaaagcatatcctcctggcggatggtgaagccaaactccgccacctcaccctttttataggccctgtccagttcaaactcaatcagcccgtccccgtaaaatccatttttcagcccgctgatcgcaccggtatagcccagcagctcacatctggaattgggaattcccaggctgacccaggtaagaggcccctccttgctgtcattaaggaccttccaccggtactgataggtaatttccagagcgccgtcctcctgtgcccttacctggacgcagtaatccaggattctgtccagaggcgtgagaatatttacgatataggcaatcagcacgcagattcccaccgcacatatacagccgaaaatcaacaggcttttcttctttttccctgtttccggagttttcccgtccatccttaatcagcctccctttccggctccgttttcgaaattctcagagggcaggacaaagagtcttcttcctccattccgcgtatggcgcggcaggcaggatgattccagatacgcttccagctgtccgtcagcatatttcccaaaggcgcgctgccgctcagccagctctggcagggaacgacgctgccgtccggagccaccgccatattggaaagacaggcgccgcacatgggcaccgccagcccaagctccttaagcaccacaggatcagcccggccgggcgaggtaaagctcagctccattccatgctgggaacaaaaagccatggcctcccgcagaagcgcattcatctcctccacggtcagctgggaggacagggaggcttccgccatagccttgcccgtttcgatgagtcctgaacaggtcacataccggacgccgttttgatacaaaaaagccagcgtcctgatatactccttgttttccctgcacaggggcgtattgacgctcacattcagcccggcctccagagcattgcgcagtcccagaaccgttttcttaaagcttccttccgtatcgggcagatccgccccggtcaaatggttatgtatttccgcattttcagaataaagggtgatctgcacgctgtccaggctggcgtcatagagctttctgcacagctcccccgtaagcctggccccatttgtattcaggcgggtgacgaaccagcgcgcatgctccaccaactccggcagatcctcccgcatggtcggctcccctccggtaaaagtaagctggcagattccggctctgcggcaccggtcgatgatttcaaaccagtcctgggcggacagctcctctgtgcctgccgctggctgtcccgccgcatagcagtgccggcatttcaggctgcagttccattttccttccctgtcgagcatggagcttaccataagatccatccgatgcggcgccgtcatattcgccgcatattcccggagggaaagaggcccgatattgcctgacggctcccctccccgcgccacaccgtaaagcagatcaagcatctcttgaagatcctcctgcagctcctgcgtttttacataataaacccttttcgtccgggacactgccttatccataacctgcttcatctgcgcctcattaatcggccgcccgtcataaacgtttacctcacggataaaattcctgaggagaatcgcccaggaatagcccagcggaaggatataatagccgtttaatatcatcacatagggcgcatccgaaaaaggacgccatttgggcggaatcagatgtatccgcaccgctcccggtcccttcggattcagtgtggtatgcaccacaccctccttataggccctgtattgggctgttttatgcaaaattcccatgatattccatttccttcccggctcccccggcactcctattcccggatacgcgccatggcgatttcgtccatataaaccccgttcctgacagccgccttccggcggatgccctcacgttcaaagcccagggactcatacagatgcactgctctctcgttatccgcaaagaccgtcagctccagccttaccaacatcagccagttgtctgccagatccagaaccttttccagcatcgcccggccaatcccctgattctggaaatcccggcggaccatcaggccgattcctgccgcgtggcgggttcttgggttggcgtttaccttcaggctgatagagccaatcaccctttccccgcctgcatcatcgcaggctaccgcaacaaacataaaatcgttcggtcccagccccgcgagcatgtcctccgtctttttcctgctttccccgggatttcccagaattgtctcaaaaacaccgggcatccgccttaacgcgctgatatccccggcatcccgcggctctaccggccgtatcgtatattccataattttttctccaatcatttcaactggcaactgcctgtttcgcagctgccggcttccggttcccgccgcgcctcagcggcagatatcaaatataaactccgcacacttgtccatggcctcatatgccgttttaaagggggacatctgaaatacatgccacatgcccttataaacatccagccgggccggtacgttggctttaatcattttcttgtgcagcatggtggcatcgctcaggagcacctcattgtcacccacctggatataggttgggggaaaatccgtcacatccgcaaaaagcggtgaaatcagcggattttcatagtcctgcccggcagcgtagttctcggtcatctgcctcaggtattcctcatccagaaccggatccacctctgctctcgtctcatgggtttttcctgacgcggtcagatccgtccagggggacagcagcacaagccctcttggcagaagacgctcctcctccttcagcttaaccaccagggaaagcgccatatttcctcctgcggaatccccgatgacgattacgtccctggcgccgtagcccagaaccatcaggtaattccatgctttcatggcatcctccatcgccgccggataaggatattccggggcaaggcggtagtcaaagcagaaaacatccatggaggtggagcacgccagcttcgtggtcagcgtccttgcataaacacagcttcccgtggaataaccgccgccgtgacaatagaggattacgtactttttcatatgcacccggttgacccgcacccattcgccgtgcatcccctccacatccacggaggtgatgtccatttccttgctgttgcccagcagcgcgccgaaataatcctgggactggcggtgtttctcaatatccgtattttctaccacgctgtgcacccttttaatcagcttcatcaggctctggttctgctcctgctctttgttctttttcagtgtatttatggatttatcaaaaagtgccatatttcctctcattccgccgtatccacagcatggtttgcttttgtcctggttgcttgtcttcatcctatcatagaaagaaaatcacgtaaagggtttacggcacaggttttcttattccccgccgctgcataaaatgtgtatttcttgcataaagacgggaatgattctataatagtatttagaaagcggccgcgtttcggcagggccttctgcatgggaaatccgcattatgccgcccatgcccaaccgcacggactgtaggaaaggaaacacttctccgtaataaataaaaacaaacagtagctgttcggtatccctcacagttacaacagacattctttactgacattatgccaatcagaaccgggaaaggaatgaaaccgatgacatctcgtttccatataaaaaaggatggcgtcaaaccggccgtcagccccagggactggtaccggctggatctgtccgccatcgtatatcccactctgcagagacgggatttttcgtccgtatacaggctgtccgtcctcctcaaggaggatatccggccggaagtgcttcagcaggcggtggatatcgcgctgaaacgcttccccacctataaggtatgtatccacaagggacttttctggcgttatctggagccgaacaaccgccccggcccttttgtcaggccggatatccacaacccctgtatgcccatgcactttaaatcaggcggccgttatctgctgcgcgtttattattatgggaaaaggatttccctggaatgccaccactgccttggcgacggtaccggaggcatgtgcgtgctgcagacaattaccgccgtatatctgaggctcctgggcgcagaaatatccaacggctattttgtgctggatgtaaacgaagcccccgatccggaagagctggaggacgcctacatgcgctatgcaaacgctctttactgtccgcccaggcccgcggagaagacctaccgggtgcgcggaaccaaggaaccgttccataccttcaacatcattgacggcattatgtccgtaaaggaggtagccgccgtagccgcaaggtacaacgccaccataaccgaatatctgaattccgtgctgctgtacgccctgctcaacaagcagaacatggattttcatctcaagctgtatccggtgagaatcgccatgccagtgaacctgaggcgtttttttccgtccaagacgctgcgtaactttatcaccatggtttatccctccattgatcccaggctgggtaattacacctttgaagaaatcgttgcccaggtgcacaattacatgcgctattatatcaacgaaaaattccttcgcggcgacatcaccacaaacgccgccaccacccgcaacccttttatccgcgtggtgcccctcttcctgaaggacattgtggtcaggaccttttacaggaaggtgcaggataaaaattcctcggccggcctgaccaatatgggagccatgaaggttcccgaggacatgaagccttacatcgaccggtttgacatttacatgggccagcccttttcctcccgcaccaactgcgccatcatcagctttgacgatacgctgaccatcaactttgccagctgtatcatggaagccgacgtggaacgccattttttccgtaagctggtggaggacggcatccatgtaaaaatcgaaagcaaccgtacctttgacgatgagtaatttttcctccctttataaaaagaaaagccggagccgcaaacagccggcacctccggcagatatcattttccacagtaaaaaagctgtatccttacagcggaatggagtttaatatgtcatattgtgtaaactgcggcgtaaaactggacgataccctggaacgctgtccgctctgcaatacgccggtaatcaatccgaatgaaataacctatacccactccgtgcccccttttccaaaggaaaacggtcaggtggaaacagtaaaaaacaaggatgtggccattctctactctctggtgctcattgctgccggagccgcctgcgggcttctgaacctgctggtgttcaacagcagcgcctggtctttgtatgtgattgggatatgcattatcctctgggtagtggccattcctgtttttatctataccaagcttcccatttatgtttccctgttgtttgacgggctttccattggactttacgaatacctgatcacctttaacactcccagctcccgctggttctaccagctggccctgcccatcactgcggtggtcacggtgctggccatcctgctggccgccctgtgcagaaaggtttcctcttccttcctggcatcggcgctctatgtgttctcggaaatcgcggtactatgtatttccattgaactgctgatccgccgtttcctgtccaaaccgttcctgctcacctggtccgccgtcgtcctcaccgcctgtgcaatcattattgtggcgctgataaccatgctttccagaaaacggctgcgcggcgcagtaagaagaaggctgcatttctgaattcagaaatgcagcccttttgttcatattacatttttatggaaattattaatccagcatatctacaaaccggaggccttcctcataaacccggttcttcgtctccaggcgctggccgttgatcgtgaccaccatttcctgcgcgtcatatgccgccaggaaggaattcgtcagcgctgccataataacggcttcgcttccttcctccatagtcttcagatagtctctgaagcctgcggaaagatccagcgtaagcttttccttatcctctgatattgtaaaatcatttaccttggtatcaaccgatacaatattcttcttgcgcagctcgccaatgattgtctccggcgttttccgcggaacctccacctcctcggtgctcagctccttacccatgcttgaaccataatatatcgtcactatctccggctcaccggttgccgtaaccgattctgcctccagctcttccaccgtttccgcgctgcccgaagaggtgatttccaaagcagtgtagtttccggtttccgcagttcctccgcatgccgctaaaacggcagccatacagagtattcctcctaatatcgtaatgctgctctttttcatgcctgctcccttctgcgcatatggcttatcgtgtttccgcagaaaccttccctgacgccctatgctcctctgattacagtcttcctccccgaaagtccgctctttcgtacagccggcatgtccgttgtgccggtatataaaaaccacgcttccttcctgccaccgattaaaagcaagaaacagcccctaaccttagtcgattgtactttattcccttcccgctgtcaaatacttttcctgtcagccgccgcgcttttatatatgacgctgttttataaatgtatctcttttataaacgcctttgtattataaacgtctctcttttataaatgtctccataatatcaagtatccgatctgtccagaagaccgctcctccatggccgccgccctcaatttcataataggccgcatccttcccggctccttcaagcagcgcaaacagctcccggctgtgttccacagaaacctgcacgtcatcaattccatgaaataacagcaccggcggcagttcggcagcttgggaaatatacttcccgcaggaagccgcttccgccagctccgggctttccaggacctccttcactcccagcagatccctggtaggcctgaagttctccggaaatccgggcggcagaggctctttggcacatttcatgatattcgaaggagccgactgcgcaatcacaccctttatccgacagggcttctcctgatacaggggcgtatcaaatatcccctgcgcttctgtaaaagccgtcatcagggcaatatggccgcctgaagagtttccggcaataaaaatccgttccgtatctatatggtagtcctctgcccttgccgccagaaaccggagcgccgccttcgcgtcctccacctgggcgggaaaaggggcaatcgttgactcccgaaactgaagtatagccgtaactatgcctctttccgccaacctggaataagcaggcaggctgttatatacttcctgacggtaccatgcggaaccgggtatgaataaaaccagcggaaaggtttcttccgccgccagcttctgtcgatagggtataaaaagctgcagacaacgtttgcagccgtcgtaatccgcatatacctcgtcaggcacataaagccattccagatcatcacattctatcttcaatttctgatactgctgattcgccattgtttttccccctggccttacaatcaatttactattttccagctaaaagcattctccgccaaatgtattgccgcttcagagaagttgatgccgtattactgcaatacagccataaatagtgccggagcattgaagcaccgatgtacagctcatctggcaggagttttaaacaagaaaaaacggaaagtcttcttcaaactttccgttctatcattcagtgcaggaaaagagacttgaactctcatggtattactaccacacggacctgaaccgtgcgcgtctgccaattccgccattcctgcgcgacaaaatgtattttatatgatctgagataaaatgtcaatacattaaaataatttttttgcataaaaattttttaaattttttacggtattttatcctgataatatttcaaaaggaactctaataatctatggcactttttcccctttcccagcccgtataaattggctgtgtggctacgaatgaggcattcctcaaagtaccccagctactctcagggctttcttacaaaaatactggctgaatacagacagtgttcgtttacatccatttccacaaattcctctactataaatcctgcggcctgcatttcagcagtataaccgtctcggtcgtttgccctcgcgggcacaagaggaatcaagatttcagctgttgattcagggcagcaaaaaggatttcatcatcaggagtatgcccccaatgttcaatgcctgcttcaaatattttctgatatctgttttcgtatgcataatagtatggtttgttgtccactttgcttaacctccataaacattatttcatgcctgtattgttttcttgggccgaacagtttttcaccaaaatccctaaatgccttttatattcataaacccatacttttccgcttgtattgctaccgcttttgccagtgctatagctgctttggcaatcacataattaagttatgaatttacatgaataatcttttattggaatataaagcagctttaacaaataaatacaacattgataaaatgatttcacatatagttgaaaaagatggtttcaactttattatacttctttgctccttataatcgcaattaaactttgcgatgaagccgcatcaattgcggggtgtggacaataaaagatgtatgaagccctgccgtaaaataccactccaaaaaatgtcttaaaaaaatatttaaaaaaatgaaaaaagtgtcttgacgtattcttcttaagatggtaatatatctcttgcagcacggaacacgttctgatgcaggcatgcggaagtgtcggaactggcagacgagcaagactaaggatcttgtgggcaatgcgctcgtgtgggttcaagtcccatcttccgcactataaagttgttaatgagaaactttgataaaatcaaagtttctcgtttttttattcaaaaaacaattacattaatcatattacgatttttatttggttccctgtttctatgttcttattgcctgaaagagcaatccgtactaaatcatctgtctcttcatcgtttttaatattataaatatagtgacgcaagtggattgccccatcggcatgtcccaacatatctttaacaatgcttatattcactccgttatgtaataatgctgatacatatgtttttcttaccttatgcattgtcttatacattcttatattattttaccatgtatctcgttcctgctaatctgtcgaatttttgtccacaaagaatgcacacttatcatgacttcttcaaaatctaactctccaacataaggattcttttttctataggaattccacaaatcttttaactggatatctttacagacagcatccatataactatcaccattttttaaaagttcatgatatgtaccccttttttgggcagttccggtaaaggccaaattaagcactgggatttcaatacatgacttcttcagatttgacagcagccatacatcgtaataatcccgcatacgtgtatttaccacattccgagacaaaatggtttccagtttttctgcaagcactgtttccagattataagccagaacattaatctttctatcctcaaacatcagttggaatgggtattcaatctctgccggtgtaatcacatcacctgtagtaatatcaatttttattgtctgcttcgttttatccaattgcgcactaataacggcccgcaggccaggatagtcaaaatcttcatgtatatcatcaattgaaatcagatgcatttccacattatcttctatattactttccataatctccatcaatatgatatgcagattttctttggataacgagaatcctgctattgtagtatcgcagtccatcgtagtcctgttatataagcctgcgatggaaccaatcagcatgccacctttcagtataaatttgtcacgatacggagatactgcaattctttccaggaaacgctccaggaagaaattacgcagtatcacttcaggctttaatccgttttgtactgccagatttcggactttcgcctttaattgtgttgatgttttcaaataagtacctccatataaaatctcatctgttctccaacttttaactttcctgcatactccatcagattttttagatttttatcttttctctttacataacgtttcaaagcatcagttacaaccgcaatatcctgatttttcttatcctttaccatatcacaaagtgtccgttccatatcatagacttttacaggatttccccacgttgtttttaactctgtaatccccatgaacaacaggtcttttctgatgttatgaacacagatactgtctctgaataaagtatgtgaatgataacctgtgggaaccgtcacgctaaggacaaagggttctctatctgtcaaatcatgaagatacaaggctgtctcgtgggaataaataaccttatctttacgtctctgtaaagtatataattcatcgtacagctcctccgagaatgcataaataccataagcaactttttccagctcaccactttttaccatatttgttaaatattctgaatgaattcccgccgctcttgcctgtgctgctgtaaaaatactatctggtgtcaacgataatttttccataatttctctttgttccatccttctctcccttatttgtaacttatactaatatattatcatatttatgtataagtcacaataaaggtagaactttaattttagctattgattatcatgtatttttccctgaaggccgatatctattccttccacacattttttcaaatacgtatgtgaggaataccttactttaactgactcccggagctgcttctttccaaagccttttccattataatcaatacgtattccattatgtccatttttaacatagtccgggcggtttgtcggatcccaggaaataaatccaactgtttttcgtcaagacaggtaataacaccatatttatcagaaatctccggccaacttcacttatccagcataatacgtactgcagggactttctgctgacttatttaaaacagcttctgaaacgtttatatggcacaaataagttttttgaggattctgcagtgattgccaaagaaagtgaacggatacggtccatcctttctgaaacagaagaatgtctaatctccatgatggaaaatttcttaaaaaagcggtatccggatagacaggaggatttttatatcagggccagaatgctttacatgattaccgacagagtttcaagggacatactctgcgtcggcacagcacggcaaaagaaggattatatggagttgcttgcggacgaaattctgcattatacttttgagctatagttatccgggcagagcccgcggtaattttgctgtaggactcatacatcgtttttatccactgctttccggtcgccaggacaccaatcagactctgaaaaacatgaaaagagacaaccttaaaggtcatagaccacaagcactgtctcttttttctcttgaacaataacttttttaaaggcctggccaggaaaacacagcacctggctatggctatagttaatctcagtattaacctttttataaggtccaataattaatacataaaaataggatactgaccatatcatttttttgtttcagcttgtttatgttttttcattagatatacacaacttatttatgtataaagcagatataataaagaggtataatttacagacagtttgtattatttgaaatttcttgatacatttctttgctaataaagaacaaaggatcaccgttctcatcataacaatctttaatcatacctattttttccatcacccgatatgatgctatgttattcttatcgcaacctccattgacaaagggcacctgtgctacatcaaaagcgtacgataagagtttttcagcacattgtgtagcatatcccttatttctgaaacctttatcaatcgagtaaaaaatatgcagcttacctacagtttctccatccagaccacaccaacctataaaagtataattttctcaaccccgctctaacttcacactactttgtatctttaaattttaactatatttgtattcctaacgctgcgacaacttgttcattaatagtcccatcgattataagcccataagccgtttggaaattaattaatgcctgctgtgtttcattatcgaatatgccatctattgcgcctgtataaaaacccagttcatttaattttgcctgcgtttgggaaaccaatttataaagcagatcatcttggctggtattttcctgttgcagtgctgctggcggtgtttccgtcgtttgctgctgtaaagctgcttgcgcttgctcctgtgcaaccacctgatttaaaaatacctcatatgctcttagaacaatcagcccatcgaaaatatcggattttgcctgggtattgagcggtaataaatctgttttttcttcagaagtcattaaagaaagcatatatgcgtcggcagcatttggatccgcagctataaattgatttataatagccaacacatcattcctgaaatatccacttttctttttattgctgaaatcatctgtgacacttttgtattttgtcctaagtgcggcatcagaatcctggacagccgtcttctgaatgttcttgcttgatgaggatgtcgctgcagaagcgccggaatatggacatacaccattaggatgtaaatgggcagggtgcccgccacaatgataatggtaagagccaagtccacttttattcttgtaatcatgatgccccccactgccatcggttctgccgctgtgcgcttctacagttaacacagtattgaacacaggaactaatggaatacaagttgtaagtataaaagtggccaataaaattgatattactttcttcattttcttttgcatggttaaatccccctgttaaattataatattataattatgaattaactttatcacaaaatagtaaatggtgccagtcaaaactactgtttttataaaagctgatataaaattacagaaatgatggcctcaaatttctttttcctgcggttttgattgtgccgattttgaacggcatacggcatctctccgccggaaatcctgtctgtctggaagaaagcggggcgttggtagaaatcagcgccagtttgaataaagccggggattacctgctgaaaaaggacaacacacgtgcagagtggatccgggggatttcccatgatatacgaacacctctttccattgttttaggatatgcaagtgaaattgaggacacggtatctttaccggaagctaccagaaagcaggcagggattatccgaaggtacagtgagaaattaaaaaacctggtagcagatttgaatttgacaacaaaactggaatactcaatacagcccctgcagaaacaaaagattgatccggtagagttagcccgtcaggttgtgagtgaagtattgaatgacggaatatcagaactttatgaattggagttgtcggaagataatcccggtaaaaacctctcgcttgtcggggatcaggctttacttagtcggatgctgaataatctgatacgaaactgtatcgttcataatcctgatggatgcacaatacaggtgtcagtgggaagttgtgatgcaatgtgtactttttctgtgacagacaatggatatgggataagtgagccgcaattaaacgcattgaacagcggcaaagatatttccagtacgcaaaaacagacgggagaaacagaacatgggctggggcttaaaatcgtgatgcaaattgtgaaagcacatcagggaataatccaatttgcagatacaattccacatggattaagtatacatatttctttgcctatgaagttataacataatcatattgtctatgcatttgggccagcgaaaagcatgctacttcagtttttccacatggctgtcaagcggatgggccggataccaaatgtcccacaggacagagttctgaatgcacagaaaaaccaccagtagaaagaaccgagcgtgggggccagctggccgccgcgttcggttctcctctatagcactttattcccctgctcttttaagtcttacagtcttcacctcaaaggccctgaaatccatcagcatgtcgccgttttccatcacagcctcttcctgcacattttccagcatatcgcacaggtaagcgcggcagccttccagttctacatgaactcttgccgtaaccgccgctttcttggattcataaagtctgaggataatatcgccgcttccgtcctccgcaggcttcatggtatctagaataatattttccttatcgatggatgccaggctgaagctctcgcaggctccgggcatggtcagcgcggggacattcagctcataaccctggcgcaccacatcgcagtccgtaaaggagccttcccaggcggtaaacgcataggtaaactgatgtactctgttgtccgcgcgcatttccggcgcggaaggcgcacgcagcagcgtcagctccaggctgtttccgttcatgctgataccatacttgcagtcgttcagtactgccgccccgtgggagccgtcacacagcgcgctgtagcggtggttgcagacttcaaagcgatccttgtcataggctttggaacggtgggcaggtctttccacgtaaccaaactgcatttcattgatgccgttttccgcatatacctgcacggggaatgcggttttccacagacggtgaagctccttccagtccacctcggtatcgaataccagccttctgctatccgcagccaggcggatatactgtgtataagaggattcgctgatacggccggtcaccttcaggattgcttccaggccctgggactggatttccaccttcacgtccacagctgcttccacttcctgttcacggtagttggaatcaatatcccaggcgtcaaaaaggcgggggacatccttatacaggtggaaacggttcatgggttctgccgcaaactccctgccggattccttaaggataaaggaaatcacctcgccgcggctgtttacgcaggccctgatttgcgtattttccatcaggaagccgtcttctgtttccgtaacggatgccgcagggttctcttctgttacagccgctatgtattccggttccgcaggctgcatggctggaatcagggcaacagcgccgcaggaaggaagttcaaccagcgcctttaccgttccgtccatcacctggacaggcaccttacggccgtctgccgtttctgcacccgttgcaaaggcctccggaagcgttaccagcgctttcctgccaaagctcagggagttgaataccgtaaccgcgtcttcgctgccgtcaagaactgccttcgctgcattttgggtaatgtccgcagcgcccttaaggatctctgtaaaggcctcttccgcctccacataaaccctcgcgatggaggagccgggaaggatgtcgtggaactgatgcaggagcagctgtttccacagcgcatccgctttctcaaggggatattcccagcccctggatgccgccaggcagctccacatttccatttcacgcaatgcaagctcgcatcttctgttgttcttctttaccatggcctgggaggtataggttccgcggtgggcgctgaaataaagctctcccacataggtgttggcggggcctccctgctcctgcatttcctcgaagaattccctggggccttccattttcaccttcacgccgccctccaggtccttctggcgcagtgcatattccacgtaatccctggacgggccgccgcctccgtccccgtagccgaagggcaggaggaatgcatccagatcctggatctgcgtcctgtttttccatacctggttgatttcttttgggtccgtgcggtaggtgtagctggtgggcaggaaggaatccacgcgggatccgtccatgccttcccatgtaaaatagtgataagggaactgatccccttcattataggaccagaaaatcttctgggtaaccaggtattttacgccgcagccgcgcagaatctgaggaagggccgccgtgtagccaaaggtatccggcagccagagaacctggctgtccacacccagttcttccttataataacgttttccatgaatcagctgtctgaccagagactcgccgctggtcatgttggtatccggctccacccacatggcgccgtccgcaatccactgtcctgcgcggatcgcttccttgatccgctcaaacagctccggataatattttctgcacatttcataggaggccggctggctctggatgaatttatattccggatattcctccagaagacggagctgtgccgcaaaggtacgctcggttttcctgtgggtttccgccatgggccacagccatgccagatccagatgggcgtttcccaccgcgtaaaaaacaggcatggtcgaaccgttaacagcttccatcgccggtttcagcgcttctctggccgcccggtagctttccgttcttttttccttgtcctgttcaaaatccacaatcagggtgaactgctccagcgcctttgcgatttttgccgcgcgcagggaggtctcatccagagtttccagcagcttgcccagtgtatccacgtccatgtacagctggtaggcatcctcatcccagatgccgtaggtgcatactcccagcgtccttctggccccttccgtcaatggatccgtaaaggaaccgggaagcacggggccggttgcgcagcctccgtcagggcattcgggataataatgccccgcataggtctccatgagcacctcatagctctctccggcttttcccgaccgtgtcagtgtattgtcttccatataatgatggggttcggatacccagtcagccctgtaggtgccgaaggaacgtccattgacgaacagggtggattctccgcccggcttcagattcattacaatccttttcccctccgcccggccaggaagctctatccggcttctgaaccaacagtattcataagtattcccccatgtgaatcccggctgtacctgctcaaacgtaagccccagcgcctgctcaggactgatgtgctccatcgtcctgtgtccttcccaccggaactctcccagcggttcgtaaaaatcgtccttcagcgtccttatccaatgccggatccggccgctccattcagaatgcatgactttcatttctaagctcctttgctttctctgataattttccagctgccgtccttacatgacagacagcattacccctctccccttttcagtgaaataatcgacagggtatgcttttgttatatcaggttaaagagcttatgacaatctataaaattttattttttctgtaaaaaaaataagaattatgtattgacattttatctcagatcatataaaatacattttgtcgcgcaggaatggcggaattggcagacgcgcacggttcaggtccgtgtggtagcaataccatgagagttcaagtctcttttcctgcactgcttaaaaaccggaacggttattcgttccggtttttttattgctttttaaaaggcccgtcaggcggcgcacttactgtgccggccttccggaccttttgctcatttttgcgatgcatcattgcaggtaatccgcagcagtttcctcctgcgcggcaggagcccgaatggcttccggcgcatccccggtaaccgtaagcagaattgcctgccccagataccccggcggcgccgtatactggacaattccgctgttttccgccaccacatccgtctccctcatatggatatgtccggccaggacagcctttaccgggcttgtgtctcccagtacaagcttcatatattccagggatgcttcattcgggtaaatgcctcccaccgcccccattcccatcgaaacaggattcttccatacctgggcagcctcccgcaccagcttctccgcggcaaaaggcacatgctggaggataatcaccggcttgcccttctccaacgcttttctgaccgtctccagcgccgcgggatcaatctggttgctgctgtcatccactcctaaaaatataagctcctcattttccagcacctgcgccgcaggcgtgccccgcataaagggggccagggccgtcagatattcgtttttgcctttttccgtcatatattcccagggataggtccagtcatgattgcccggcacatagagcacgggcatttccaatttccccaggttttcttccaaaaagtccagattggactgagacgggaaatcaatgatgtccccgccgagcagcacgccgtccaccttctgttcattggcatatgccatccagtccggaaaggtttcctcaggctttcttccctgtgcatccagaaacagcgtatctcttctgggaagcgcattctccagctgctgctgtgtctcttccccgttcagcgtaatgatatgggtatccgaaaggaacagataccggtaggcgcctaccagtccggggacaatgatggtctgttcctccacctgcagggcggcggattttactgaatcctgcctgtctccctccgggcagggaccgtttccggcttcttccctgtccgtatcctgcacattttcagctgccgtctccctgttcccggcgttttcctcatccccgggcgcttcctccgcaggcttttcttccttatccggcagcagcttgtcttcatttctttcctttgccgccggttccgcgggaatctcctgcctggttgaaataatttcctctccgccgatatccttcagctccggctttctgttccctgctttttcaggagcagacgttacctctgcgtcagactgattcttcttattcccccgatccgtcatttccgccgcattattcccacagcccgccgtcagcaccgccagcaaaactgccagcagtaccgctgcctgaggcattcctctcctgaattttgatttcataaatcttatcactttttttctccccggacgcttcctgccgcccgttctgcctgacagctcattcttccttctcccagtccgtgcctgaaattgcctcagcccgtttctccttattcagcccgcgtcccgtgtgggcaacattgcttttgagaaaacttgccctcatgacggaatcctccccgaatttggcgcggatgctgtcaatggcgcggtcacatttttccagtttgtcgtatttttccatatcgaacagattatactgacggtattcctcatgggaaacccgggaggtggatacaccaatcagccgcagcggccttccatcccacagctcgtcataaagacggcaggccgcctcatagatttcctctgtcacatccgttgcgctgctcagctgcatctgcctgtttctgttttcaaaatttgacgtacgaagcgtgatgctcacacagcttattttcacatgatccgcccgaaggcgcatgcccacggtttcacacagggataaaaggatctgtctggcgtacttcacatccgtaacatttacaggcgtggtcatgctgtttccgtaggccttattgccttcctttgcttccagtgtgtcctcttcctcacgtccccatgcataattccagataacctcgccatgctttttcatgtgggccttcagagcgtccacatccgaacgggccagatctcctatcgtataaattcccaggctgtgcagccggtccgcagctgcttttcccaccagaaacagcctttccaccgggagcggccacattttttcttcaatttcctccgggaacagggtatgtaccaaatccggttttttgaaatccccggccattttggccaaaaggcggttgctggacacaccgatgtttacggtgaagcccagttcctcccggatctgatccttcagcttccaggcaaattccaccggatccccataaagcatctcatagccggtaaaatccgcccaggcttcatcaatgctgtactggaccacatggtcggaatagcttttcagcagcgatatcagagccttcgaattttccacatacagatggaaatccggagggataatgatcaggttcgggcatttcttccgggctgccactatcggctcccctgtctgaatcccatatttcttggccggcgtgctcttggcaagcacaataccatggcgagcctcctgatcgccgcccacaatggacggcaccgtcctcaggtcaagctcctctcccagcacatggcaacggtatgccgcgctccagcttaaaaaggcgctgttaacatctatatggaaaatgatcggtcgtgcactcatataaccacactcttatttttcgtatttcttcataaatctgagaaccgtttcacgataacgcaccggctccacaaaattagaggttccatgggccgcttccggcacaataagcagctccttcggccctgcgcaggcagaataattatccagcgtcatctgcgtgggcacgaactcatcctttcctccatggataaacagaatcggaatgctgcagtttttcaaaatatccagcgtggaaacatccttatagccaaagcccgctttcttccggttcaccgcctcggtcaggttcatcagtggaaacagcggcagtttaaactgaagctgcatcacatgcctgaaaatatcgtaagggctggtaaagccgcagtccgcaattatgcccctcacattctccggcaggcccagtcccacggccataagcaccgtcgaactgcccatggaaattcctgacatatacagattgcagtcctttccaaaacggcgcacagcgtattccgcccacatcttacagtcaaaccgttccttaacgccaaaacagatatattttccttcgctgtccgcatggcttctctggtggggcaccagaagatgatacccctggtcatggtaaaatttaaacagccccgcaaaatcggaatacccgtccgcccggtagccgtgcataagcaaaagaactttattgctatccgtttgtgccggaagcagataggctgacagcctcagcccgtcatagcttgtgagcgtgattttttccggctgctgagccttaaaccaggctatgccttcgtctatcttatcacggaagcagtcaaaggtcaggccctgtccggccttaagttcaggcacttttttctttttctttttcttcttcttttttttcattcttacaacggaataattgaagaaaaaggccacgccgccggccattaccgccgctggcagaactgctgccgccgctatcatccctgcttttttcctgttcaattaacttgccctccttttttatggcagaaagtaacggttccgtcccttcacagctgctgccaaaggccggaccgccgcaaactgcggtaatattctcccggcatttccggtagtctttggtattcagtttatcactatgctaaaatccttgcaagccatccgtccggaatataagccacaaaaaaacggcgccgcctcaatattgacatgctgccaatatatgagggacgccgtttttatatcagatattattgcccgggaatctggggattccgtcgaaaccagcctgcaggtcggcatcggtgggaatataatctttcatttctccattatggaatttctcataggccaccatgtcaaagtagccggttccggtaaggccgaatacgatggtcttttcttccccggtttccttgcacttcatcgcctcgtcaatagctacgcggatcgcatggctgctttccggagcgggaaggatgccttccactcttgcgaactgctcagccgcttcgaataccgctgtctgctccacgctgcgggcttcgatgtagccatcatcgtacagctgggacaggatagagctcatgccgtggtaacgcaggccgcctgcatggttggcggaagggatgaagccgctgcccagcgtatacattttagccagggggcagaccttaccggtatcgcagaagtcatatacatattttcctctggtaaggctggggcaggaagcaggctctactgcaatgaatttataatccttttcccctctgagcacctctcccacaaacggggaaatcaggccgcccaggttggagccgccgccggcacatccgatgatgatatccggcacgatatcgtatttatcaagcgcggtcttggtttccagaccgataatcgtctgatgaagcagtacctgggaaagcacgcttcccagtacgtaacggtagccttcctgcttggtcgccgcttccaccgcttcggaaatggcacagccaaggcttcctgaggttccgggatgctccataagaatctttcttcccacttcggtaaattcggaaggggaaggggtaacctttgccccataggtacgcattacttcacggcggaagggcttctgctcataggatacctttaccatatatacctggcagtccagcccgaaataggaacaggccatggaaagcgcggtgccccactgtccggctccggtttccgtggtaacgcccttcagtccctgctgctttgcatagtaggcctgggcgatggcggaattgagcttgtggctgccgctggtgttgtttccttcaaatttataataaatcttggcaggcgtctgcagcttctcttccaggcagtacgctcttaccaggggtgacggacggtacattttataaaattttctgatttcctccggaatgtcgatgtaggcatccgtatcattcagctcctgctttaccagctcatcacagaataccggacgcagctcctcaaaggtcatgggctgcagggttgctggatttaaaagcggcgccggcttattcttcatgtcggctctcacattgtaccactgcctgggcatctccgattcttccagatagattttgtagggaatttctttgtttgccatagttttatctccttttcttaaatagacagacaacctgacaggggaaagcgccttattcttaaggcgggtttttgataatgaaaggagcggtatcgttctgtacgcgaaccggggcttgattccacaggatctgatttcctgtaaaaacaaaaaaccgcctcaggatctcccgacaagggaaattcttgaggcggtaataatcctattatcgcggtaccactcaaattgacgcttcgtccactctttccatacggccaggactgcaatcctgccatatgcatgcacaactatacacgccggtctgataacgggtccggattcccgccggcgcctactgggtaaattaccatgttcaggccggcctcaaaagtccattcagcatgagttcctataccgcatttccaccagttgcggctctctgggatatttcctcttgatgcttactactctttctcacaggttttttcttttctgttactaactaacttatagcaatttcaggaatatgtcaatagggaatttatacttattgactgcgcttataaagaaaaatgctttcccgcctccgccatgaggcagctcttcccgaatgccattttcatccgggcaatggccagtgtcccggtacagtgcagcggtatcagatacgtaaagcccgcttcctttaaacccgtaatggtttcctccacccgttcctgcggacagccgcgcagatgcatccctgcaagcaaagaataaagcttttctccgggaaaggtcctttttaccttttccacgcagctcagaatgcccggatgggcgcagccggcaaaaacggccagcccctgaggcgtgcggatcacaagaagctgctcatcttccatggtatccggcagatatctgccgttctgcaggatacggaagggcttttcccccatttccgaaggcactgtggtggaaatctgtcccagcagataaataccgggaaaaatctcctcctgttcccaggtaaataccagaggcagccgttccagctcctgcacatcctcccgccagggcacgccgatgcagcggttccctttgccatcccctgccagacaccatttatcctccagagcctttccgctcagatagaccggacagctgacctcgcctggaaattccggcaggcctcccgtatgatcataatgcccgtggcttaatacgatggcatcaagcccctccaggctgatacccagctgttctgcattatgtatataaacgccgctctgccccgtgtcaaacaggatgcgtttccctccttcttccaccagtaccgaaaggccatgctccgcgagcaggccccggcggcttaccgtattttccgttaataccgtaatttccatccccgcaccttctttttctttaaaataataaagttaaattctcactttaccttattttttaataaaaatcatccaattcccttatatacaaatccaagaatcaataccagtactgtcagcggcacataaatatactttgccgtaaaaccaaaagcgtctgataattttcccttatgtcccttttccagttcctcccggattttcggatagcccagcacataataaaccgacacggcccccaggacggcgcccagaggcacgatgacgatggataccgcatccagccattttccggtcctgctttcctcctccagaaatactcccaccagaaaggtaatgccgccgcacagcagcgtggacaggaacctggaaatcaggaactgtgtctgccagctttctataaccgcctcaaacatattgataagggaggtgattcccgcaaagctgacggaaaggaagaaaaaggccgcaaacagccttcccatgggcatctgccggaaaacgcccggaagcgtgataaaaatcagggacgggccgctgcccgcatcgatgccgaaggcaaacaccgccggcattatagccagccccgaaagcagcgccgccatcgtatcaaacaatgccgtccgcaccgaagcccccgggatatccaccttatcatccagataagccccgtatacaatcatgccggagcctgtaattgaaagggagaaaaaggcctgtcccatggccataacccaggtatccaccttcagaagcgcctcccatctgggcacaaacaggaactcatagcctttggccgcccccggcaggaaggccaccctcaccgccagtatcacaaataatacaaaaaacaggggcatcataaccttgctcactttttcgatccctttggtcactcccgtcagaagaatcacggaaaccaccgccacaatgataaaatgccagggaacgcttccaaaggcccccgtggcctgtgcaaaatactccgcagcatccgtttcaaacaggcttcccgttaccgcccccgcaagggaacgcagcacccagcccagtacaatggaatagccgatagcaattccaagagagccaagcagcgggaaccagcccagcaccttccctgtcttttccctgtccctggccgcaaaacaatagccataggcccctatggtcccggtccgcgcttttctgcccactgcaaactctgctgacagcccgacccagccgaacaacaggataaacagcagatagggaatcaggaaggccgcccctccgtactgtcccaggcggtagggaaacatccagatatttcccagccctactgccgatcccacacaggcaatcacaaagcctaacgttgatgtaaaattcccgtttttatgttgtccgttactcataaatcctccgtatttgaatagttgtaactgttcagtacccctcacagttactgctaaaatccatcctaaatcgcctttggcgatggattttagcactcctgaatcactttcttacggtcagcgcaaagcgctggcctgcgcagctaaatgcgctgacctgctgaacagttacgaatagttacaatattttttctgcaagctgcttattttatgcatttttccagcagcttcctcgttttctccacctcgatgggcttcacaagatggccgttcatgccgctttccatggactttttcatatcctcgctgaaggcattggcgctcatggcgataatagggatgctcacgctgtcttccttttccgacatgcggataaaccttgttgcctgcaggccgtccataaccggcattttgatgtccatcagaataccgtcataataatgtggaggagcgtccaggaatttttccaccgcctcttttccattcacagcttcctcggccataaatccccatccttccagaagggttactgcaatctcccggttaatatcattgtcctccacaaccagaatgcgttttccggaaaaatccgcagcggcggcggacttttccatccctgcatcccctccgcgttctccggcaaagggcatggaaagcgtaaaataaaagcaggagcctttacccggctcgctttccacctccagcttgccgcccatcatctgtaccagacggctggatatggaaaggcccaggcccgtccctccgtattgtgaggccgtgctggcctctgcctgttcaaaagaattaaaaatggatttctgccgctccttctggatgccgatcccatcgtccgtcacactgaaacggagccgcagcagctcttcatcagcatctgtctgctcaacccgcagcgtcacatggcctcccggaggcgtaaacttcaccgcatttcccagaatattaatcaatatctggttcaggcgcagatcgtctgccataatcggccgtttttcctcacagcttacttccgtactgaaaataatgccttttgcttccgcctgaggctcaataagaattttcaggctgtttatgatttcatgcaaatcgtttctctggatattcagctccaccttgccgctttcaatgcgggacatatcaagaatatcgttgataagctgcagcagataggtattggccgtttctattttatgaaggcattccgccatcttttccttatcttccagaaccgtcttcgcaatcgcagtcatccccataatggcattcatgggcgtacggatctcatgggacatacgggaaaggaaatccgtcttggcctggctgacggcatccgccctcgctttcatggtaaaggagctgataatccgggccagttccttgataagccgcttctcctcatccgtccattcatagccctcttccttcttttcccagcagaaagcgcctgcatacgtcccctcattccagaacgcggcgtgcagcacgctgggcatcatatgctgatggaaaataagcttttccgtactggttccgtctgccgagtaaacactgaggatatgctccagatcctcccggcttaagtaaaacggctccgtctcatgataccccacagccttgtccgcccactggtaaatacaggagacattccggtattcatggttgacttcactgatgcataccctgtccagcttcatccgttttccaatccggacaagcagcaggttcatggcgtcggagatgttcctggcttttccgagaagctccagcgcaaaggtggtcagttcttcatcagcgctcagattgctgctgccgacactgttgatcagcagttcgtccgggtacaggctggtcagccagctgcccagctcattagaggtatccagataacaggccgcccggcccttgccgtttttcttcaaatattgaagcgtgctctccgcacagcggtaaagcccgctgtaatcctctacaacagaggtgacgcacatgccgatgctggcggaaatacccgattccccttccatatcgggaaaaaggccgcgtatcctttcggcaattgcctttccctgcaccactgcttccgccttggtacagttttccacaaaaaccatgaactcatcgccacccagccggatgaggatatcctcatccttcgtttcccgccgcaatacatccgccgtttcctgaagcagcacatccgcaaaaacgctgccggaaacgtcgttgattttctgaaaattatccatatccagaagcatcaggccacagacctgatccgccctcttatgctccagccgttcctttacaagcgcaatacctgcttccctggtataaagcccggtcaggggatcctgcgtcctggcttttctcagggcgatttccatctccttttccttggtaatatcctctgtgatgcccaccacgtagccaggtttccccgtactgtcataccggaggacggaaagcgtaatgcgccgccagttcttccggtcctgatccataaattcgcctgtggcggtccgttcccccctgtcaatggcccggaacatctgaagaaacgcatcatgatattccggcgccgcatattccctggcaaaggtttccgccatattgatgcaaaccggcgtttcccggccatagaattctctggtgcgctcaggcagcgtccctataccgctgacaggatcataataaaactcatatatggatgtatgctccagggaaaggcggaggaactcattcccggcctccagctgcttctccagcagccggttcttctgctcgatttccttacgtctgttaatatccagaaatacgctctgcaccaccagctcatcgtccagatcccggataagctcagcgcttccgataacccagcattttcttccgtccctgcactttacgcggtattcataaaagaacttatccccggcttccttcagttcgtcaattcccttaatgatccgctccctgtcttcctcacaaacggtggacgtaagatcccattcctgcttctcccagaattcctgttcctcatatcccagaatccgtatggcttctttgttggcatttttaaaccgcgccagcccgttatccatcatggaatactggataatgccgcagagcaccgactgaaaaagattgttataccgctgcttttgcctttctgtttccttcagctgctgtccctgcacaaggtttgtctttctcagccgcaccagttccgtgatatcctgatgataccctctgatacggtaaatctgcccttccctttcatagaccttgccgctgcatctgacaaaaatttttcccatctgcggatggttccagtagtactccacctccgccagttctcccgttttcagcattctgtccgtgtaatcctggaccgctttctcgtagccaggctcaatccgctcctggaaaaaggcaaactgctcctttggagtaagctccatatgctccgttcccagcaggacgtgcatctgctcatccggatacatccgaaactctcccgtctcattatccacttccacgatccacatgccaatccggccggtctgcagtacttccttcagccagtcggccttatagagctgattttccaacccgtccctgttatccattgcccctcaccttttcctaccgtatctgtcctgcaacaaactttctgatcctctccgctttctggaggccgctgatatcttcacggaataatatccccagctgcccgtagacacaaaaggaagctaccgtttccggatcctccaccgcagtgagacgccccagcttcatctcctccgtgatcgcatccgtcacatgaggcaccagccgctccgccaccttcagtgaaagcttctgatagacgccttttttgtccgggctgttgaaaattttataataatagctgtcgtcatcctcaatatggatgaaagactgcgtactcataatcttttcccgcagcgttgtccgaccgtccctgatcgcttcccccatctgctcagccagccgtccggcataattttccaacgccccgtcaaaaagtgcctcctttgatttgaaatacctgtaaatcagcccctgcgccacccccagcttcaacgcaatgtcactgatggacgtcttttcataccccttctcataaaaaacccgcattgccgcgtccagtatctcctgccttctttcctccgatgcctttgaaacgcgcatttccccttccctccttacaaggtaaagccaggctcgtcacccggctccgaaaatttttccgtttatgtcttcaattgtcagtttttccagcctttcatagcagcggcgatccagctgatcgtaaattccgtcaagaaggccggccatccccgaagccacaaggcagtccatatcctggttcccgctcttccaggaggaagaaacaaacctggcctccaccgcctgcgcaatcatgctaagcgtcaccttatccgcaggcccgttgaataaatagcctccatccagcccttccctggtggttaccagccccgctcttttcagcttcgccataaccttgcgcacacgggccggattggtacatatattttccgccagcacctcgctggaaaccatttcccccttatggtttaaaaaggtaagcgcatgaaccgccatgccaaactcacttgtcatatctgctccctcacattttttaatatctgaaataactgttttgtacctttacagttattacctgaaaacaatatcatatcacattccgccggttatctgaataactttttttgcactgcggatactaattgtcacagttcatccgggactgtattgtaactgccggcaactgggaaaaaacaccgcggcccctatatggcaggccgccttggaaagaaaggacatttgaccatggataataacgagataccggattctgcactggcaaaaaatgcgctggacagcattccgcagaccaaaagtgatgcaaaggatatcgtgggtcttgtaaaggaaagcggccgtatcaccggctatcagctctccgacggctccacggtttccaaggaagaaggcgttgccctggcaaaggacggagaaatcaggggagtcggcatcgcccaccgaaaggataccgaatatctgaaatccatccctgacgaaacagaaaacaacaacttaagctcccttccctccgttaccccggaataaaatacttcctggcaggacaacgcttcactgattaaggcgcgcgggctttatgcccgccgccgggttcccggcgttttacctatccgtccttgttccatacggcctggaaaagcaataacagtttttccctttcctttttgcctcatacatggcgcgatccgccgcattaaacagatccacaaactgactcccgtcctccgggcacctggaaatccctatgctcacggataatggcggtatcccctgctccatgcccagcttcaggtgctgcatcaaaagctctgccttctttcctgccagttcccggctgttcgtagaattaagaaataccatccactcatccccgccgatgcggccgatcacatcatcggccctgaacaccttctgcaggcagcttcccacaaagcagagggcttcatcgcctccggcatgcccataagaatcattcaccagcttgaagttatccaaatcaatcatgaacagcagtccgatgcattcctcctgaagccgcctgcggatttcaacctctgtggccagcttgttgcgcagaccggtcaggccgtctgtctccgacatttccagaagatactcctcatgccttttttgttcctcaatgtccgtaatcttaccaactacggaagaaacggttccctttttgtaatcatagcggtactggatcagcgtccagaaataattatccctgtcaggatacatcagcctgacgcggacttcctttttatccttcttcagccggccggaaaacagctggctgacttcctcaatatcaccgccgtaaatatatctgttccccatatttttcaggaaatccttctgcaccaggccatgaattctgaaaagcctgtcagcattgggagtaaaccggataatatcacgccggatatcataatcaaacagcaccgtatcggaaaactgctccagcagcaaataccgccgttcctccacaccgatatgctttgccattttcaggaaaagtgaaaagaggaaaacgcagaagacggctactgccaccagaagagccacagttccgcacatggtacggtaaacaatcctttccatatggctgttggccatatccgcctggaagcacaccacataatgccagtcgttaattcccagatccactacagaaaagtaaatcggcacgccttctctttctcccacacggatgctggcgttttccccattctccaggtacttcagcatatccctgcagatatcgccgtcaattccttcctcggccatcctgtccgccaggctgccttcccattccccgtcgccttttttcaccgggatgatattgccctgcccatcggtgatcagacagcggaacacttttccctgtaccgcagggtaaaaagatgtggccacaagcatatccgcattgataatgccccgaagcgtccctgcaaactttccgttttgataaaccgggacgccgatagtaatacagtacaggccgccaagcttgtcagaatatgtaatatcggaaatgacagtctcgccttccttcagacgttccactatccgggcgtcctcctcccgcactttcccggtccggatactctcttccagctttttctcactcgtatagatataccactcatcctccctggcctcgcttaaagcggtcagatatccttccacagcatacgtatcttcctgctgtcctacaagaaccgccaatgcatccagcatatttttcatcctgtccatttcagccagtatttcttcacgctggcccgaggtataggtattcaggttctccgtcatgatctgcgtaaattccgaacgcgctgaattataaaaataagaaacggccagagctacggaaatactcaggaaaatcaccgctgccaggcctgccgccagataccatcttctgtcaaatttatattccccgttctttgcgtttttcttttccacagtcttttttttcacaggttcggcctgctgcacattcctttcggaaggcacctggtaaaacccaccggagctttcataccgggcataaaaatcctccggcggtatgggcctggaaaaataatacccctgtcccgtcgggcagcccagccgcttcagataaaggcactgctcttccgtttccacaccctcgcacagtacctgcacatgaagacgctgcgcaatatttatcatattcggtacaatcgcttcattcctgtataccagttccttttttgtggaaaggaacttcttgtccagcttcaggacatcaaaattcagttcctgccatatattgattcccgaatagccggagccgaaatcatctatggacacccggtagccgtacgccctcagccggtcaatcagctgcttggctccggaaaattcatccagcagaatggtttccgtcaattcaaactccagaagatcggacgggatttcataagcctgcgcgacagaatggatgatatcggcggtttccggattatggatatgcaggcgcgacaggtttaccgaagtctgtaccaccggcagccctttttcccttctatctgccaggaaggcacacaccttcctgtaaatcagcatatccagctccacaatgctcccattggcttccatgacagaaagaaaagcatccggataaataatgcttccatcacggccgacccttctcgccagcgcctccgcccctatcgtcctgcctgtttccagatccaccttgggctggagataaaaaaggaacctttcctcccggagggagtcattgacagcccgctccagctcatactgatcggtcatctgcttctgcatggcgtcactgtatgggaatgcccttaaggagccgcgcctcttcgcctccttgcgcgccagattggcgccgtccaccgcatattttaagtttcctccggttactttgcagataccgcaggaaagctttaatgtacataaagggtaattcgttccctgttcctcaaggaacagacgggaacgctgctgataagatatgatgattttttccacatccacgtctttttctgtccgtatcaggcagagaaactgatcagaaaaaatatttacacaggtcctgacctggggatcctttttcagagcctcctccattgcccgaagaaggctgtccccggcttccattccatagaaatgattcaccatctgaaaatccgtaaaatccagatacaaaagataatacgcaaaatcatctgataaattctgaagaatttgatttgattcctgcagaaaactttcatatggatacatgtactttccctccgttttattgttctgaatagcaggcagaacttttttctaaaccggattcattctaccagttacacaatccattacaattatagcactctgcgactattttttaaatcattttacggtcaattctggtcttaaaccggtatttttaccaattcgctgctaaattacccgtcatctgctgtttaatatggctttccatgccatgtttccagagcaaaagaggggcatatcaaccaatcacagcagaacgtacgcccgccgggcgcgcaaaaacaaaagcaggctcatttcagaacctgcttccactccccttcatcttcatataaataatgctcatttacctcgtccttcaggaacagctggaacatcagctccattccggaggcaagcggctgggccatcagctctgaccgttttacccagtatacctccccttcctccgaggaacgaagctcgccctcaaaatggccggttttataacagaggaccacgtagcggacatcttcctcttcctgccactgctttactccgcaaaggacggggtttttgatcttaaggccggtttcctcataaacttcccggattacggaatccgtgaaggattcctttttctccacatggccgccggggaatgttatgccgccccattctttatcctttctgttctgtaccagaacgtttccgttgtcatcgtacaccatgcacatattggtaaaaatcgctttttcacttctgtccattttatcatcctgcctttttgcttaatcagccgtaacagttcaaccggggaccgggctgtcacaatcagtattcagccgtttccgcattaaggcccgtatccatgctgcccgaacggaatccctccaagtcaagtgtaacatacagaaagcccagcgcttccagtctggaaaccagatcttttctgtgtgccagtaccgccggcatgtccttttcgtccacttcgattctggcaacctccccatgcacacggatgcgcacgttataaagtcccaggctgcgcagataagcttccccctgatccacctgtttcattttatccatattcagcctggtcccataggggaaacgggtggccaggcagggggccgagggccggttggaaacggaaatcccatattccccggcaaacttacgcacctcctccttggtgatgccaagaagggccagcgggctggtaatgcccagttcccggatcgcccgaatgccgggacggtacaccgtcaggtcgtctgcattggttccctccacaatcaccgggacgccaagctcctgcgccttcttcttcattttctgaaaaagaagttttttgcagcggtagcagcggtcaaccggattgtcttcaattccggcctccgccagctcgtctacggacagaatcacatggacggcccccatttcctttgccacacgtcctgccacctcaatatcctccgttgggtgaagggcggtctgtatggtaaccgcatatacttttttcccggtccggcctgcgctgtcacaggcggccttcagcaggaggctgctgtccacacctcctgaaaacgccaccatgatatcctctccggcaagcttatccatcatttccgccagtttctgtctcttttcctctgtcccttccatgaatactccttttaaaagacttcctttttaccgtacggcaaatacgcaggcatgtctgcgcatcccctgtacggagcgtgtccggacatttattccgcaggctgcacgtcctgtttttccggacaggccgcctttatcatttcataaacctccataaaggggcgtttatgttccctgctcagcctggcggcatccgcatattccggatagtatctgttttctccctccagcctgcatacctttacggatgcctggcccagaggcgtgccgacctgtattacctctcttggcagcacagtcctttccatacatagcctgcggatgccgatggtagtggtttccgcaaaaataacccgttccagcctgtccgcatcctcttcggagcagataacattcagctggtaggcagggcggttcttcttcatgaacacgggaatgtaatgcacatccctcgctccttcttcaaacagcctgtccatgacatatcccagcatctcgccggtgcagtcatcgatatttgtttccagtttgcagatggtgtcctttctgctctcctcaccgcggatcagcatcgcccgcagtatgcttgggcgttcgtagctgcgtttgcccgctcccattcctgttttcactatggtaaaggcttccggaagcttatcatccgtcttcaccgcagccacaatggccgctccggtgggtgtgaccagctctccctgaatttccgtcagcttcagcttcagcccgttggccccggcgatgtttgcaaccgcgggtaccggtacgggaatcatgccgtgctggcatctgacaaagccgctgccttcgcagagcacaggcaccacagccctggtgatattcagattatccaggcacaccgccaccgccacgatatcgacgatggagtccaccgcgcccacctcatgaaaatggacctcctccatcgggacgccatgggcggccgattccgcttccgccagtatccggaaaatgcggcaggcagtttcctttgcccggtctgaaatttcagcatgatctatgatatgaaggatttccttcaggccgcggtgctcatggtggtgatggtgatgtccgtgatgttctccatggctgtgcccttcatggacatgctccccgttgccgtaaagatactccatatcatgatcatggttctcatgcgcctcatccagcaccacattaaaatcacatacatccagccctgatttcacaacccttttgatttcaacggaaaagccgctaagcggcaggctggaaagcgccctgcgcagcacctcctcgtcagcccccaaatccagcagggccgccaccgtcatatcaccgctgatgccggaaaggcattccaaatataaaatttcgtccatttatgctcctgtccgcctgcacctgcaggctccgtttttctgtcctctgccgtatattatacaccatcaccctgccgtaccgccagcctgttaatctgcgtcgccatataacctgcgccgtagccgttgtcgatgttgagcaccgcaatcccgttggcacaggaattgatcatggtcagaagcgcggacagcccgtgcatattggcgccgtagcctaccgaggtgggcacggccagcaccggattgctcaccagcccgccgatgacgctggccagcgccccttccatccccgccaccgcaaccacgcagttggcgctctgtatcacatccagccgggacatcagcctgtgaataccgctcactcccacatcataaatacggtccacatttgagccgaaatattccgccgtctgcgccgcttcctccgccacgggaatatccgccgtacctgccgtgcacacggcaatcctgccaatcctcttcttcccttctttttcaatcttgaggatgcgggaaatctcatcatactgtacctggggaaattccttcttaatcagttcgtactgagaaagcgacgccctcgttcccagcacctccccctcttcctcatacaaatgtctgaaaatctccttcagatgggcatccgccttgccgctgcagaaaataacctccgcgaaaccggaacgcagctttctgtgggaatccagcttggcatatcccatatcctcaaaaggctgacgcttcagataagcctccgcttcctccagtgacatttccccgtttttaaactgcattaaaatttcctgtgtatccattcgtcttctcctgtctgcctgttttcaacaactccgttccctgcagccctttcagctccacctgcctggtgcatacgtaatccagaagctcccggctgtggctgaccaccagcatgccaatctgccgccgtgcagtctcctccatgaggaaattccatatctgcccctgggtaatcagatccagcatggtgctgatttcgtccgcaatcagatacctggtacgccttcccagcgccctggcaatgcagaaacgctgcagctccccgccggacagttcctggggaaaacggcccttccagtcctcttcaatccccagcccttcttccagcctgcggtcaatgccgtcgccctccgccagcgttttgcgcagtttgaggcgggggttcaccgccctttccgggtgctgccagaccatctgcaccggacagtagccttttgcaggaagcggtttcccatccacaagtacacggcctgcatccggctgcagatatcctgccagtattttcatcagcgtcgtttttccataaccgctgggcgcaagcacgcccacccgctccccggggcccacgctgaggctgacgcccttgagcaccggcggttctcccttttgataggagaaaaaaatattttcagcttccagcatgtccgttggcctcctttaccgccgattccaatccctttccatggtggtgatgggaatcatcctccctgcatttgatgcagcgcaccgtaccgcagcgcaccacccgttccggaatttcccccagacattccggagagaaatccggacatctcggcccgaatacacagccttccggcagatccttgacataaggctgcacaccgtcaatgggagtaaagccgttccggggcatagccctccataaagccctggtataagggtggcgcagaagctcctgggaggcaaaatctcccaccaacgcttcctccaccgttgtccccgcataaaaaacggcgattctgtccgccacctccagcgccagttcgatatcatgggtaatcagcagcacgccgtttcccgcatccgcaaaccgccggaaatcctccatcgctttttttgccagcgccagttccatgcccggggtcggctcgtccgctatgatcagccttggattttccatcagggccgttgccaggagaatccgccggctcattccgccggaacaggcaaaagggtatttttccgccgtatcctccggcaggccatactgggaaaaaagcgcctgctgccgcttcccggcttcccgatccttccttcctccacgcacctgctttcccaccttcatcaaagggtccaggtaagtgacgctctggggcaccagcgcaatctcttttcccctgatatgcgcaagcctctttggcgtcagcggctcctgaaggaaataaatatccccgccgcaccgtgcattggagggaagcaaccccatgaccgcgtgggcaagaaggcttttccctgagccgctggagcctaccaccgctacgatttccccttcatgcaccgccacgttcagcctggatatgaccggaagatccacctgtctcgtccccttgtcatactgccggaaggaaacggacagatccctgatttccaatatatgaaatttctccgaacagctcatgttccgcctcgcttatttctgaaaaagtattttcttaaaatgttatttgtggaaatgcagcttaccctcacagttactcacagttaccgccaaagcctgccctattcctgcacgctggacggatccagcagcctcctgagcgcattccccgccacgtcaaacagctctaccgtcaataccagcatgacgcccggaagcacggcaagccaccatttccctgtaatcaggtacctcatgctttccgacaaaatgacgccgatggcaggctgctcggaggtaaggccgaagccaaggaaggtgatgctggcctcatgcagtatggcatggggaaacatcagtatcagccccaccgcgaactggggaaaaagatggggcagcatatgccttacggcaatggtaagctttccctgtcccagcctggccgccgcctgaatgtattcactgtccttaagctgcatgacctcgcttcggataactctggccagagacggccagtgcgtcagcgccacacctaacaccacgcccttaaagccctttccaaaggcaaaggaaaccagaatcagcagaaggatatggggaattcccataatagtgtcaatcaggaaggaaatcacagcgtccacccggctccccagcacggcggacatgatccccagcgccagggcgatacaggcgctgattcccgcggtgcacagtccgatgcggatgctcatggaaagccctgtcagagtgcgggccagcatatcccgccccagccagtctgtaccgaacagatacaatccgcagggacgcaggttttttacgctgaaatccgtctttcgcgctacatcatggcaaagcattccggacagcgtcaccgccgccaggaaaagaagtgccaggccgaaaatcagcagggttctttttctccggttcatgaaggctcccctcccttcctcatacggggatcgatcacaccgtaaagcacatcggcaataaaattaccaagaaaaacgatgcccgccgtcaccagcgtaattcccatcagcagcggcacgtcgcttcccgtacccgccgtaaccgccgcctgccccaggcccggataggaaaaaacctgctccaccaggacggagccgccgatgatttcactgacggaagcgaactggagcgtcattgccggaagaaggatgttacgcaggccatgcctttttaccatggtccaggtgctttccccccttgcccgggcaaaaagcatgtagtcgctttccatgacatctatcattttttcccgggtatgcagcgtaattcccgcaacgcctgtaatgcttaaggtaattgcaggaagcacggcatggcgcaccctgtcaaaaaaggtcacacccgacgcctccacgccgatgggcacgcttaagccgataggaagcaccttcagccacacggcaaagacaagaagcagaagaagcgccagccagaacacaggcgtactggaaatcaacagggaatagcccctgatcaccctgtcgagccaggttccccggaagataccggcaagcatccccaaaagcagtcccaggataccggaaatcagccaggcgatcaccataaggaacagggaattggccagcttcacgccgatcacccggttaaccggctgtctataaagcagggaggttcccatatccccggaaaggaaagcctttccccagttcagatagcggcgtaccggaggggtgttcaccccccagtattcctccagccgggccttctgctcctggctcatggcgcccagcgccgcctgtcccacattggcctgcagcgggtcaatgggcgacatgcttaccagggtaaaggttacaatgctcaccgtgaccagaagcagaagcattcttatgaaatttttcccgattcgtcttaccagacggttctctttcacgtttatttccactcccactgatccacattattgacgattgaccatccatgcccatgaggatggattttctgtccggccacctgcaggccgtcccttacataataaagatgatccacattacacaaccatacccaggggatatccccctcctgggtaactccggttttcccgtcccactgtgccttctgccacagctcataggtggattccagatcccctgccttcaatgcaccatccatgtaattatccactgctttattggaataaggagaatattccgcacttcctgtggccggaagggtatggtaaatattataaagctccatgggggtatgcgccccccacccccataccaggggctgcgtctgcgccttatcataagccacatcccagcctgcgccctccgttgtcacctcaatgccaagctcccttaactggtttgccagatcctcggccaatgcctggcgcaccgaatccccgggggtatacatcaccgaaaaggccgccctcaccccgtctttttcccggatgccgtcactgccttgcgtccagccggcctcctcaagcagctgcttcgcagcgtccggatcatatgccacctgcgccgatggattataccagggcatcttgtcacatacgctgtaggccggcgtaccatagccattgagcacattgtcaatcatttcttcccggtcaatccctatattaatggcacggcgcaccgccgcatcggaggttaccgcattgccaatgggtttatcgtcccgctcctgcggtgatactgtgggaaggttaatccccctgttatccacgctggccacccggagcagctgataaccgtcaatcacctgatccgcataggacgccgccgtatgcgccacatccgcctggccggccatagctgctgccagcgccgcatcctcatccatgaacaaaacggtaagctttttgattttgatttcctcgccataataatccgggttcgcttcaaaaatcacctgctgccccttatcccactgcttcataaggtaacggcccgagccaatggggttctgcccgtaattctcatcataagcatgctccggcacaattcccacaatagccatggtataaggccagatggaaaaaggcgtattcatgtggaattccaccgtggtatcatccaaagccacagcttccttcagcatggtaaaatcattgacgctgctgttctgtacacaaaggttgtaggtaaaagccacatcggaggctgtcaacggctctccgtccgtaaatttcacatcgttccgtattgttaccgtccaggtaagcccatcctcgctgacagagtaatccgtggccagatctttccctatttttaaatctgccgtggtagtcgtcaatgtgctctggatcagcggctcatgcacatgctcacccgcaccccagccataaacaggatcaaagcccgcttccggctccgaggtggacggcatggttacaattacggaatcctttgcctgcccggattccccctggacgctctcagccgccgcgccctgcgcttctgctgcctgtcctgactgtgccgggtcctgctgcgcactgctgccgttttccgcactgccgccgtttcccatgttgccgttttcagcactgctgccgcagccggacagcgcggctgcaacaaggttcacagctaaaataaatgctgctattgttttctttttcatttgtcgttgtcctcccatttgtgtcagatatttcttcccggaagagcttcccggaaaaacatacgccggattttatacatgctgtttcatccacacatccgttcgggcgccaaacaaaaacggatgccgtgaagtatgcttcccttaaggaatccaacgccttcatggcatccatagttccatcattaaaattattataaaaatgcaggaagcaccgctgcttcccagacgttcagcgaattgtacctgtatatgcagaaatgagggaactgtacttcggtacattatatgcattcttggaatgccgccctcctgccagctacagttattaagtatagatccgcatcctccggcagtcaatattttcctgcccggcctgatgtaattgaaagatatacagccctgtctgaactgttacatgtgattcattttatcacctggagcaggctccaatacaaatgaattttttatgtctgttttgtgaacaaattatgaattacgcattttgcttatcctgataaatactgtcctttttccggatcttaatgcatgccctttatctgttccagataatctcagggtcaatatgcgccagatccgcacagcccgtatgtgccatcatccctgcaagctcttccgtaatggattcgatcttttcccgcactccctcagggcctttctctcccaggggccccatgagcgctcttcccacacagaccgcatccgcgcccagcgccagcgctttcaggacatccgcgccgctctcaatgcagcagtccacgaaaacaggaatctgcttctgtattacttttgcaatagaaggcaggattttaaacggaggcactgcgtaatccataattccatggtgatgggaaaccacgattccctgcactcccgcctccaggcatttatatgcgtcccgctcactcaatacgccttttacaataaacggcagcttcgtcgcctttacgaattccttcagctcctccagggatttcgccttcatctgcatgccacagacgttatcataggttcccttccaggaaaaagcatgatccatgtccattcccaccgccaggacaccacatttttctgcatgtctgatccggctgataatataatcgttgtcttcatagggcttgataatcttaattgtccgcgccccagtggccgtgattctttccagctcttcttcatcacccatgccggcccagtttacggctccggccagatgcgcgccttccgccagtccggccatccctgtctcatgtacattattcaggtgggacagggcagctgtcattaccggcgtggcaaacgtttccccgtaaagctccatttccgtcaccggcagctttccgtccagatgacgcatttccagcagtagtgagtccatatattccctcgtgattctgttggaatctccggggttggttcttttttcttctcccatttttaattcctccctatgtatttattgcttgataacgaacttataaaggcagtgaacctaagctaacctgctctggcagaacactccttctatatatttacccctgttatttttccggtttcgccttgctgaataacatgcaggtcacaatcaccattccaacggatgcgaaaagaaacacgaaataaaccgtagccaccggggtggtgctggtaattcccgcaacgttcgcatacagcttgccatcatgcagatacgctgttgtctccctgccaggcatgtaggaataactgttataaacattctgcagctcgtattcccggccttcgtactccactaccacctcgtaatacttctggctttttccatatacacgcctcactctttcttcagagcttacgacggttgccttcacctccgtgtattccacgtcaaccttgtccatggcaatccgcagaaccactgctgctacgatacacagtacagtgataatactgctgataattgctttcttcttcatttttttattccctttcttttttattttaacagacacagcgcttataacgccgtgcccctcttcggcacaaataaccgggacatatccacgccttccagttcaagcagctttattttggcaggaatacctcccgcatacccggtcaggctgccatttgcccctaccacccggtggcatggaataataatggaaacagggttatgccccaccgcaccgccgattgcctggcccgacatgcttgttcttcccatctttgcagccattttctttgcgatatccccataggtaatcacctcgccatatgggatttcacataaaatacgccatacctcctgacggaatttgctgcccacaggcgctaacggcagttcgtctgccacgggcttttccccgtcaaaatagcggtccagccagtccttcgtcctgtcgaatacaggcatgccgcttttttccgtcatgccgtccataatggtattcccatgatatttctgcccctccagccataaccccacaagcttgctgccggtcaaatcacaggccagggtcaataagcccacaggagaaggatatgttgttgaataatacatgctgctccccttttcttcctattataaatactcttcccgcctaaaaagtcttgtcaaactcctttacctcttcacggtgcagatcatcattgtagatatcggattcataatatctcccgccctttgccggaagtaaataacccggaatcagctccattgccataaaagcagaaaaattatatccctcacaatccgaaatcccatacacagaagcttccttaaatccaaactgcggataatactccggcctgccgaaaaatagaatggctccatgcccctctgcttttgctttttccagcatcccgtttataagcgcctttccaacacccttccgctgatattcgggcaaaacgctgagagggccgaaattcaggaccggcagcgttatttcttcttttcggaccaccgctttgctgcatataatgtgcccaaccacctgctgctccacttctgcaaccaggcttaaagataatattccatccctgcggcgcagctcattaaccatccaatgctcgtagggacagcctattttaccattttcaatccttccaggataggaaaatgcctgccttgtcacctcttccacacggcggtaatccttttcttcctcctgccttacaaaaatattcatgtctcatacctctctctgcctgtttttccagaaaaacttaagtgcggcaaacaatatgaacagaacaaatcccggctcccgcatactccgggacccggaatcctttatcctaactttgcatctgttcgtgatcaatgatgccctcattctcctttttattcctgtacatacatgcgtcggaacgtttaagggtatcattaagcgtcttatcctgcgccgcatcataaaaagcgtagccggccgaaatactgatatcaaaccttctgctctggctctcctgctctgccataacgcggatttcccgcagcatatcctctacctcttcctgcgttacgtcctggatcattgcgataaactcatctccgccgatccggtacagcacacatttgccatagatggcatcctgtatgataccgctgctgactctcagataatcatccccgcacccatgcccgaaggtatcattcacatccttcagccggtccaaatcgaaggaaagtatggccagcccctcttttttcccctgctgttcccggttgtgcagatccacctcaaaggcattcctgtttttcagtccggtaagcatgtccgaattgaatatatccctgtaggaaggattggaaatcctccggaacagaagcaccgcaatcacagcggccgcaatgcaggacatcaaaatcaccacaggcgtagctattttcataaaccggaaagcctgatattccgtcccggcatcgaattcgattcccagcacgccgataacctgctccccgtcatgcattggaaaataggaaataaaaacaggcccccatgtcgtcttgttaatctggccggggaacacggtctctcccgccatcgcccgtttcatgtccgcaatgcactcaggctctatggcatcccccacataacggaaatcaggactgtcttcagaaaggccatccaccagataaatataatcaccgtcctttgtcactttggcagtataaagataacgtacccccgtggccctccgcgcagcttccagaattgtgtgggaactgtcgtaaaccggctgctccccgtcctcttttacattcaggtcataaaacatgctcacatccagataattttccaggtatttatgtatgttttcagcccgttccttcagcgcagtaatcatactgccgtaggaaagactgtaattaaccaggaaaatcagcccgcaggcaaacaccacaatgacagccgtcatgaggaaaacctgcacatccacccggttgaaccgaatcttatgtcccttgttattattattcaaaattcgtaccctctcctcttatgtatactccagccccttcactttaagcattcttactggaattatagcatactgtggtgagaattggtaatgatacttgacattttttcattcttctatcgctccgcaggcagcagtccgcccccgcctgagggataaatttccaaacacgctcaaaagcggcatccccgcatgatggaaatgccgcttttatattttttcaaacaatcatggaactccgccctttccaactgacaggctgccctgctattttctatccggccggcatctgcaaagcttatacatcagctatacatccgtcctgcaaacccgcctgcacgtatatacggcggccacaattcccacaaggcacagcagaaccggaactgccgctatactgtaaagccgtccgtttacgttgtccccaaagcctccgttaagcaccatgctgattatggacgccgccacaatcgtctgggatactgatttttttcgcataccgaagggcagggcaagaaggctgatgccgcagagcagaacaccctccagaaggatccccggcaccgcttccgcagccatctgcagggaaatatgctgggggaccatgttcttccagttgttaatcagggttaccgatacaatataaacaagattagacaccgtataccccacgaaggtaatcagggaaaccagcagcagcttgcagcccagcagttttttcctgggtatgggataggtaaacaggttcctggcgttaccggtgtcaaattcccctaccacaaccctggcgatgagcactccggcaaacacaataaaacacaccctgtaaagaacatcgcctatcaaaaacagttcctgcaccgtggtaaacggaaaggttccatcctccgccagcgtggaataacaaatcaacacgacaaatcccaggcagaaaagcataatggaaaccagggctatcagcgtgcccgtaaacttttctttcataagttccagcttcattaagtgaatcattccccatcctcccctaacataccgaagaaataatcctccagcgtatcatttttgcttcccatgttcagaattgccacccctgcctgcaccagcagcctgctgatttcatcaaagggcagatcctgataaatacggagcccggaatcggaaatgattttatagttcagccgtccgtatcgttcttccagcgcaatggccgcttttcttacgtcatttacatggacctccagatattggaccgcctctctgcggatttcctccatcggcatctctctaagcatcctgcctttattgataacgcccacagtatccgccagctgttcgatttcagaaatgatatggctggaaatcagaattgtggttccacaggcctctttcagatgcacaagcaagtccctggtctgccttatgcccacaggatccagcccgttgatcggctcatccagcaaaagcagctttggctttgcaagcagcgccctggcgattcccaggcgctgcttcatgcccagagaaaattttcccacgattttcttctcacagccctgcagccctacctgctccaacgcctgttcaattcttccttcctcataaatccccatgtactcacagtgcagcctgagatttcttcccgcgctgagcttttcataaaaacagggcgtttcaataagatttcccacataacgcagatacgtataggaatccggaagcaccggatccccgaacaccctgatattgccgcagtccggctttgccaggttcaggatcagcttcatcaccgtggttttaccggcgccgttgggccccaggaaaccatagatttccccttccttcacatgcatggaagcgttctttaccacttcttcatttccgtaccttttggtgacatcctccagtacaatcacatctgacattttcttctcactttcctttatccggcggtctgccgttttttctatctgactgataacgattatactgtccccggccattcaaaagataacaaattccttacattttcctgtcaggccccttacatctgcacatcctgcggaaaaaacagcgtaaaaacagtctccctgtagggcctgctcttcacacggatgctgccgcccatggcttccgtcagccgcttggtaatcgtcagccccaggccgctgccctggtatttcttgtttctggaatcctccagcgtggtcagcctttcaaaaattttatcctggttttcctccacgatgccttttccccgatccgtcaccctgatcgcaagcccgcggtcctctctggcgacagaaatccccagataccggccatccgcgccgtaacggagggcattctgaatcaggttccccagaattctcttcattgcctgggcgtccccgttcatatacagctcctcctccggaatggatgcttccaccgtaaaacccgcatcctgaagcatttcataataccccgccagctcgcttcggcagatttcgcacacatcgattttcgccttctccatctgcagctcgcctgactccattttggccaaatcaaaaaagagcagcagcatatccagcacatccctggttttggcatatattttttccacctttgtcctgacggcaggcgcaaggtttaactccggggccagcagcatctccgcatatccgtacaccacggtgaggggcgttttcagatcatgggatatattaacaagcatccgccgttcccgctcctcctgcaggcgcgccctggccgtcaggctgccctgcagctccagcagccggttcacccgggccgccagctgacgtacggcaggctcgtccgagtatacaagcacgctgtcctcccctccctttttcagggattcgtccagctggttattcagatcctctagctgtcccgacagcttcctgtatttataaaaatacacaataaacaacgcggcaaacaggctccccgccgccagacatatcacaagcttcactccgcttcccccgttcccattttataaccgatcccccagacggtcttaatatagaccggcgccgaggggttatcttcaattttctcccgcagcctccggatggtgacgttgattacattttcatccttcaggaaattctcatcccataccgattcataaatctggattttcgtataaaccctggagggatttccggccaggagcctcagaatatcgaattcctttgcagtcaggctgataccttccccacgtttttgtacggtcagattacccggatcgatgagcagatccccgattcgtatctgcgtctgcccggcttcgttctccctttccggcatgctcctggcgtattcgttggcccgccgcaggaaggcctttacccgggcctgcagctcaatcacggaaaaaggcttggttatatagtcatccgcgccgtattccagtcccagcaccttttcatattccccgtttctggccgacaggatgagcaccggcaccgtgcttttttccctgattttacgcagtacggtaagaccgtccaccttcggcagcatcagatccaggactaccagatcccagccctctttctccgaaaaaagctgcaacgcctgctggccgtcctccgccgacgtgatacggtagccgggcagcgataatgcttcctctatcatgagccggatatccggttcgtcttctatgattaacagtctgaattccatggattctcctttccccgccgtcgcaggttcctccggcttttttattatatcctgtgcatctgttatcagcaagtgattcagctccccccctatgtttaaaaatgtatattattgtgaacaattcttaatatggaagaaaaacctttatttacctgcctatatttgctataatcagataagtaatgccattttggagctgtcggaaaaagccctgaaatgggacattacaggtggttttttgtggatactggttccataaaacttcctgttttaacttaaggaggcataatttcatgaattatggcaaaagaggtgccgcaaagaaaaaaaaggcactgcgttccaaatcaaaaaaatggagcaagcgatttgctcttaccttttttaaagccattcttctgctcattctggccgtgggaattatcggtgtctgcggcggtctgggagttgtaaagggcattctggcgtcagcgccggatacggatatcgatgtgtcacccagcggcttttccacctttgtttatgatgcggagggcaatcagattgccaagctggatgcggaaggctccaaccgtgtgcctgtaagcatggacaagattcctgagaatctggcgcatgctttcgtggcaattgaggacgcacgtttttacgaacataacggaattgatatcaaaggtattatccgtgccggtttcattggcctgacttcgggacatttttccgagggcgccagtaccatcacccagcagctgattaagaacaacgttcttacaagctggacaagtgaaagtgaaaaaggctttgcggtcaaggtaaagcgtaaaatccaggagcagtaccttgccatcatgctggaaaagcagatggataaggataaaatcctggaaaactacatgaacaccatcaacctggggcagaacaccctgggtgtgcaggcggcttccaagcgttatttcggaaaaaatgtatgggagctgaatctctccgagtgcgcggtaattgccgccattacccagaatccttccagatataatcccatcacccatcctgagaaaaatgcggaacgccgggaaaaggtgctgggcgacatgctggagcagggctacatcagccagtccgaattcgacgaagcgctgggtgacgacgtttattcccgcatacagattgtaaatgaggaaaccggcgaaacagccatcaactcatattttgtggatgcattaacggaaatggtcatggaggatctggaagctgcaggctattcggaaacccaggctttttccctgctttacagcggcggcctgaagatttacagcacgcaggatcccaccatccaggctatctgcgacgaagtatgctccaatgaggagaactatcccgacggcactacctggtatctgaattaccagctgaccatccagcacgccaacggggaaaccaataattacagcaaggaaatgctggaggattatctgaagcagaacggaagcgataaaaaatatcctctgcttttctcctcccaggacgatgcctatgcggcagccgagaactataaagcatcccttcttcaggacggggacgaggtgcttgcggagaaaatttccatgacgccccagccgcagatttccatgaccattgaggatcagtccaccggaaatgtggttgcccttgtaggaggccgcggcgcaaaggaagccaaccgtacgttaaatcgcgccacctccaccaccagacagcccggttccacctttaagatcgtatccacctacgcgccggctcttgacagcgcggggctgaccctggcggatgtatttgtggacgcgccgtttaactatgccaacggcaagccggtatccaactggtacagctccggctaccgcggaatctgttccctccgggatggtatccgcgactccctgaacattatagcggttaagacgctgacctccatcaagccgcagctgggatatgattaccttcagaatttcggctttaccaccctggtggaaagcgaagaacgtaacggacagattttttccgatattcagcagtcacttgccctgggcggcatcacccatggcgttaccaacatggagctgaatgcttcctatgctactattgcaaacggcggcacctatattaagcccaagctttataccaaaatcgtggatcacgacggaaatatcctgattgacaacaccgcaggggaaagccgtcaggttatcaaggaaagcaccgccttccttctgacggacgccatggtggatgttgttacctccggtaccggcacaagcgtcaacttcggcggcatgtccattgcaggaaaaacgggtacgacctccgattacaacgatgtatggtttgcaggctacacgccttactacacctgcaccacctggacaggctatgacaataacgccaagctttccggcaagaacggtgaaaggaacctggcgaaaaccttatggcgcgccactatgagcaagatacacgagaatctggaaaacaaggcctttaatgtccctgcggatatcgttaccgccaccgtatgttcccagtccggcaagctgccgattccgggtatgtgtgatgagactctgaaaacggagtattttgccaagggaacggtgcccacggaaacctgcgatgtgcactatcagggaatggtatgtgaatattccggcctgcccgctacggaattctgtcctttcggcgtgcccggtacggtaaccatgacccctgcactggatgcggcgctcagcggcaatgttaaccagaacgcggacggtacggcagccaaccagtgtcctcataatgccgcattcttcgctgatcccaatgccaatgcgataatcgcccagcagcagctggagctggatgcaaggcatatgctggccaattacgatgcacagatggcaaacctgcaggcagccctgcagaacgcgcaggcagtgcttctcaatgcccagcagcaggcagcggcggcaaccgatcctgacagccaggcagcggcgcagaacgcaatcacccaggcgcagcaggaaatcgacaacctgaattctcagattatggccctgcagaatgcccatgcgcttcagcaacaacaggaccagcaggccggaacgcccggccagtaaatcagtaaatacagttggaaaaataaaaagtcccgggagctccatggcggccatcgccaatctcccgggaccttttttacctctgtcatcctgctgtccggcagctgcatatgcaaaccgctgcctgatttatacaataatatcgtattttgttatgtcaaacacggcttctcccgtacaggaaaaggcgattccatccgcttcaagaggcgtatacagcaaagaggtcatcgcctgctccccatcattcacgaaaagctccagcgcatatttatcaagtagcactctcagccgaatacagccatccttctggtccacatacatggtccggctgcagatcatgtccttacgctgcccgctgtaggttctgtctgtggtcagcgtcccctgattcacatcatagcttactgtagtcacataatctccgtccgaagccagatgaactgtaaaggatgaggccctgcgcacgtccacgtccagcgtcatatccaggactcttccgctgattccaggaagcctgcgctggccgtctgcctcacacagcctcacatccctgcaggcaacctcattcctgcggtaattttccagttccctgacaggattctgtatcagtttcccactcttaagcttcagttctctgggaacagtcatcattccggaccactcaaaatcctccggggtaagataattatcccagctttgcagccagccgaccatcacccttctgccgtctgcagtttccaccgtctgcggcgcataaaaatccatcccgaaatccaggctttttgccttgcctctatggaatttaccgttttcctcatcaaagcttcccacaaaatatatggaattatgcccgttatggaattccagcccctccgctctcataaactgcggcgacacaatgagcacatggctgccgtccagcgggaagaaatccgggcactcccacatctttccatatctgccgccgttggcgtcaagaatgcttttaaactgccatttcacggcatccgccgaagaaaacagggccagctgcccgcttccatccgcgtccagacttccaattacggaataaaaggtatctttttccttccagattctcggatcgcggaaatctaccacagagcttccctcaggcagggcgtcacttttgataaccggattgcaggacagcttttcgtagttgacgccgtcgcctatggcaatactctgggtctgccttattttatgtgttccgtcctcctgcagcctgtcatagacgctggtatacatcaggatatgttttccgccgtgctccaccgcgctccctgaaaaacagccctgcccgtcatattccgtgtcaggcgccagggcgcagggaaccagctcccatttgataaaatcctttgttttctggtgcccccagtgcatggggccccaggaagtgccatagggatagtactggtaaaacaaatgatattcaccctgatacctggaaaatccattgggatcgttgatccagccgaccggcggagtcatatgaaatacacatttctgttccgatggtatctgctccttctttccggcctcatattctcttgccctgtccaattctctgctcatctgcgttctccttaatacttgataaccgttctttcttttggccgctgcctgtactctggccgccatgctatcttggccaccgttcttttctttccatcagctttccgaagggctgatgaggctcggcctgataccagtaggctacggaagccacatcgtcctgtctctcaaacaggcctccgtgatacaccccaatctgctggacagtcaccttcaaatcctcctcaaacaggacaggatccatgatgtgccaacggtaaaagcttctctggggcatctggtcgtcgttgtggtaatcattatgcagaaaggtgtcatggtgggaatagtacggatagcccaggaacggcgtacaataggtgttctccaccgtacgtccgttctcctgcgtggcaaagctccatgccccgccgaaataatcctccgtcccggttccgcatatcgtgggatactcttcatccccgtcgatataaaacttcacctcgccttccccataccagtagcgttccagcgttgtcagagccatataggtgcccacgtactgcccgcgtcccttaacgccgtccagaatcacataatcctttcctttttccgtcagacgcgctcttctccagctggcatgaaaatacccggtatcttccggaagttcatccagaaggcaataatccacctgataaaagaaagcatttactgtctcatcacactggttttcaatggtgattttagcctttttcctgaaaggcatggggaaatagctgttaaagcctctggtgggattcaccgctatgggcatggaatttaccggataggacacgccgaagccacagcagaaaaaatctcccagcgggctttccacagaagggctttcttccccgtcccaatacatacgcagcacaagatcccggagaatatagcggtttctgtcgcttgtcctgtcagtcaccgtaatccagatatgctgtatcacgccgggaccgtctatttcggccagcgtcacggtttctcccggctccagtcccggaatacagggcgagcctttcctggaaggccccaaatcactggccgccatccctccctttcctttttctcctgtccggttctcccagttaatgcttctgctttttccctttttcagcaggggcaggccgctgaggctcccataaaacatacgctttccctccttaaaaaagcaggcaaatcgaactgcccgcttatgtggttgaagtggttatgaaacgattcatatttagttgtatggtatcattaatggatagggcttgtcaacatggaatcgatgacaaataagctgataacatccgcaagaacatattagagctatatacctgaaattatctgtataaggcaacattatcattacagcttttttataacaataacatcaaatttcccattcttaactatgtagctataatgccgctcatctaaaaatggcagcaggctttcttccataatcactttgtccagcttccagcttgcgcagataagcaaaacgccttctggcttaagaactctcatactctcggaaataacccggggcagattatcaagatgccctaccgcgttccagattacggcagtatcaaacttatctttattaaattccatactgcaggcatccattatcttaaaatacacattatcaattttattcagcacagtcggcactctttttctttctatgtcaatacaatatacctctttagcagtacgcgccgccagaatagtcagttcagcacctccgcatgctatctccagaacggatctatctgtaaaataaccgctttcctgagcaagcagttgttctatcattttcatgatttttccggtccctttcttctcttatctttgatgaatacatcatagcatatttaaaggtaaatcaccgcctgttctgtaaaattctcaaataccactcgtttcatgctctaaatcttcatacatcaaaccatcatacagttactctcttcacctgagtcacccgccccccagctgctaaatcccggaatgcacagacagacggcaaaccgctgttgcaccgaaagaaataaaagacatatcttaacattactgcctttctgtaaaatctatcatcaatacagtaaaaaaggtaaaatccgccgatttcagcggcatatatttaaatggaaggggttctaatgataaattcagacgagttaaatcagattttagaaaacttaccctttatcatagaaagagacaactctgcagactatgatttaagtgaagatgtttccagtattgtatattatgttgatattttgtaactgttcagcaggtcagcacatttactgcgttgaccgtaagaaagtgattcaagagtgctaaaatccatcgccaaaggcgatttaggatggattttagcagtaactgtgaggagtactgaacagttacgatatttttaaatgcggcaattcagacgttgtcagcagacatatcgatatcgaatttatattcggggactattttgaactgcatgaagaggatgctttatcccaatctatttccacccggtgcagtttacagacaatatctgaagaatcagaaaattgtccctgattaatattccaggattgttcctgtgaattagtgccataaacggactgcccctgcatggccgcccatttatccatctgattcagcagcgctttataactttcaggcgctgctgcaattttatttttcctatgtaattccggaaccgcggttctctaatatcaatattcacccatatccttatactttgtcagaactgcaatccaatcgtgtgattttccggtaaaatcctccggatttataggatagtgaatattataaagcaaaccgtttccgccatatcgtccctgcttcgtttcgtccagatgctgttcatccacacatacattgaccacttccaggcacattaatacatgggggctgttttcagttatttcccgttcccataaatatttacactccaaattcatgaagcactcttctataaccggtgcatcaacctttgacgctggttttgcagtaagtcctgataatgcaatttcgtcatcctcaaacccattatgtttgatggttgccaggcaaagttcatatacatcagcagacgggaaattaagaaccacttcgcttttttcttttatagtctgatataaatgcccttttttattgacgcttgacaatatcgcataaaatccctttgaatcaccgttaaaacaagcccaggactgcaggcatgcattcgttttcccatttgatttatatgatgtgactacaaataaaggagaaggaattgccgttacaaaatccatccaggaaaagccataagtttctgtttgagccattgactgtgggacagatgaatattcttttttcattttgacttgctgttgtgtctgccattgcctgcactgctcaattctttttccattgtctccctcttcctcggcatatgcaaactgattaagcatttcgcaggggaactccggacagctgccgcaatgctcctgttttctcccttcacagcatgattttaaaggacaggcatcgccccagaaaggcttgtctatatttacacaacctttacatcccatctgttcccggtacttgcactcactgcacagcaggccgcatcttgattcaatcataattttatacctcctatctgcacacagaataacacaagtaacacgacaacagtatgtcatgttacttgacaaaattttatgccatatatattttttctgtttgcccgggttcattctgattgctatatgctttttcctttgataactctccaaaaacaaaaaataaaaaaaatgaaatttattgttgacaaaacagattttgtcatgctatactagctttcggtgacagcgagaaacacctcgcaggacaccggaatgctgctgtggctcagtcggtagagcgtcgcattggtagtgcggaggtcacgggtccgattcccgtcagcagcttatgaaaagcccgtaggttacgggcttttttcatgtcatcaaataaaaccacctgaattcaggtggttttatttgatgatcatttgaaaaacaaacatatttaagctgccattataaagacaacggcttcctgataaatgaagtgcatttatttacattgcgcctgaatctgatcgatgtatgattccgtcaagaaaatccaggctattcctatttcaccacctgatatgcaatataagaatcgtcctcaaagaccacctccatatgctcctctatccattcccatggaaaatcctgcgtattcatctcatacggccacaccagcgcctccccttccggcccggtctgcaccttatccatgagcacataatccggctgctcataatccattaccagttccttccctctgcatctgcgaatatggaaatacagattcagccgggcatacacatcacccacaagaactgtatccacctcctgctcatccaactgtttcagagccgcataaatatggttatccctgctgtcatagcccgcattatattcaggcagcctgcagctgtataccgaaaataaaatacccgccgccgcaaacactaaggccgttgctttgcccacacgcgcaaggctttccgtccctttccctttaaccataaggctgcgcaccatattggcccccgcatacaccatcagcacaaacagcattgccagtacgcttcccatataggtaaaaacccttagatacgggaacacacactgcatcgtcagaaaaaccggcaccatgacggtcagaaccaccgtataaagggccaggaaaaacacaggcatgtccttcctccgaaaagccctgatacacaacagaagtgcaagtaccagcccgacggctgtcagcacaagcaaaatgcgcccgccgtttggatacacctggttcgcaacccgttccagatacaggataaattcactgttaaagcggctcctgtcaatactctgaatattcggatcggagagcatcgcctgcatgcctctggaaaaagcggcaaacggcgcatgcagcagcacataaaaatgccccttcccgaaaaatggtcccgcttcctccttcacaaggaaattggagccaatagcgagccagataattgtatacagcccaaaggttgccaaagctgctgtcagagaagcccctatcagccggaacaacgtcttgtatttccctgaaaaaaggagatacagccctcctgccatgcacaccggaaccacccagtacagattgctggcaatcgtataaagcccgcccgttaagcatgccgcaaatcctacataataccagaagcgtcggtctattttccgcccttttattttcctgccttttatttccctgccgcttattttctgcagttcctttatcccgccttcacccttctgaccgcctttttcatattcctgccctgttcctgcaaaagcaccactgatcccgcctgcatcaggtacacagatttcataaaggcaattcaccgctgccagcaggaaaaaaccggaaagcgcatagcctctcccctgggccgcctgctgcaccacattatacattgccgcaaacagcgcggcgcccgccgcagccagattggcagggacagccttgcgcagaatacggtacaaaagcagcaagctgcccatggaggccaggaaggaaattcccctgagcccgatataagggcttcccagcttgttcaggaccgccgacaacgcagagaaaaacacatggttattcggcagcggccaatgaatcatggaatagattacccctctgtcaataaagttttcataggtataaagttcatcgtaccagggcggaatcgagaacatacgccatagataataaatccccatcccgcaaaaaagcaggcagaacagggcattctccctgaaaaatcccgcagggccgcgttttccgtcatcctcggaagccgttgcagcctcggaagcatttgcagccttggaagccgttgcagccttggcgcctttgccagcttcagcggctttggtattctttttattcttcatttccaatcacccaatcattttattctgcagccgtaccgcttcccccggccgctttgtttctttttacagtatggacagaaaaaaccggcagcctcctttacgctccggatagctgccggttttgtttccgcttcctgcgctgtccggcacggtctgccgcatggcgcaattatatcatatctttttccattattccagttcgctctttcctgtatacagctcgtaatatctgcccttcatggcaagcagatcgtcatggcttcctctttcgatgatctcgccgtgctccagcaccataatggcatcggcattgcggaccgtggaaagacgatgggcaatgaccagggtggtacgctccgccatcagacggtccatccccttttcaatatgtttttccgtcctggtatccacggagctggtcgcttcatccaggatgagaatgggcgccctggaaatcgccgccctggcaatgttcagaagctgcctctggccctggcttaaattcgccccgtcaccctcaatcatggtatcgtaccccttatccagcctcatgataaaggaatgggcgctggccgtcctggccgcctgctccacctcctcatccgtggcatccagcctgccgtaacggatattttcacggaccgtccctgtaaaaagatgggtgtcctgaagcaccatggcaatgttgcggcggaggtcatccctcgagatatttttgatatccacatcgtcaatggtgattttgcccttatcaatgtcataaaaacggttgataagattagtaatcgttgtttttccggcccctgtagagcctacgaaggcaattttctggcctggctttgcatacagggaaatatccttcagaatcgttttatccggattgtagccaaaggtcacatcctccagccgcacatagcctctgcagttcgtcagctgcaccgcctccggtccgtcctccggctccggcttctcatccataacggagaaaacccgttccgcaccggccagcgcggaaaaaatggtattcatctgcatggaaagctcattaataggtctgctgaactgcctggaataattcacaaacacagtaagcccgccgatatcaaagcccctgagcacacagaggatgccgccgatacaggctgtcagtgaatagcctacctgccccaggtttcccatgacaggccccatgatacctccgaaaaactgcgccatgatctgcttatcccgcagatcataatttaaataagaaaattcctcctccgcaatctcctcatggcagaataccttgaccaccttctgtcccgttaccgtttcctcaatatagccgttcagcgttcccagcgccgcctgctgcgccttgtaaaacctgcggctgcgcatggtgacaaaacgcgccgcctgcatcatcagcggcaccgtaaccacggtaatcagcgtcagccagacattggtatacaccatcaggcagaaggtgccgacaacattgatcatactggaaatgatctggaccacggtattgttcagcatttcccccaccgcatccacgtcgttggtaaaacggctcataatatcaccgtggttgttcgtatcataaaaccggaccggcagcttttgaatttttgcaaacagctcatttcttattttaaaaatagcatgctgggatatcccaatcatcacgcgggactgcaaatactgggcaacgattcccaccgcataaatacacgccataatcaccagggaatgcaacagcttatccgcgctcccgttttcggaagtcaggctgtttatgatgggacgcagcatataggaaccagccagcatggcaatggtattaattatgacacatgtaaaaaccagcgcaagcttgtatttttcctcctggatataggaaagcagcctttttatggtttttcctgcattcttcggcttgcctccgggcatccgcccacggcctcttcccggcccggggcctccaggcctgggtccgccgggaccttttccctgtgcgccggcctgctgcgccgcataggaatattttctgatcaacgcttcttttctggcctcgttcatgatgcgctcacctccctgtccatctgggaatagtaaatttcctgataagcctcacagccggccagcagctcctcatgcctgccaagccctacaatccttccttcatccataaccacgatctgatccgcattcatgacggaggtgatgcgctgcgcaatgatcagcttggtggtatccttcagcgtcccggtaaagctttccctgatttttgcctccgttgccgtgtccaccgcgctggtgctgtcgtcgagaatcaggattttcggctgctttaaaagagcccttgcgatacataaccgctgcttctggccgccggacacattgacgccgccctggcccagctgggtctgatagccatcggggaaggtttgcaggaaggcatccgcctgtgccgcttccgaggccgcacgtaccgcctcctgcgaagcttcctcgtcgccccacatcagattctcctcaatcgtacctgaaaaaagcacatttttctgcaaaaccatgcccacgccatttctcaggtttttcagggaataatctctcacatccacgccgtccaccaatatccttccttcatccgcatcataaagccggggaatcatggaaacaagcgttgtcttgccgcagccggtggagccgattatccctaccgtctggccaggctctatggtcaggctgacatcgtcaagcaccttctcctggctgtccttataataccggaaggaaacctgctgaaactcaatccgcccctcctgcaccgtttttgatgtctgttttgcattctcgtccgtcaaatcgatttccgtatcaaggatttcgttgattctcctggcgctggcaaccgccctggagctttgcaaaaaaaccatggccagcatcatcagtgacatgaggacctgcacgatataggtagtaaaggctgtcaggtttcctacctgcatatcccccacaagcacctgctttccgcccatccataccactgccagcgtggttgcgttcataaaaaaagccatgaggggcatctgcaggataaccaccttgaaggcccgcaggctggaattctttaaatcctcattggaatcggaaaaacgcttttcttcatattcccctctgacaaaggatttaataacccgcacattctgcagcgtttcctggatattggagttaaccttatccagcttcttctgcatgatggtaaaccttgggaaagccgtcctcataatgattgtaatggcaatgatcatgaccggcatgataatcagaaataccctggccagccttgcgttcatggaaaaagccatgataatggctccgatgagcattcccggggcgcgcagcatcatccttaaccccatcataatcaggttctgtacctgcgtgatatcattggtcagcctggtcacaagggaaccggtggaaaaagcatcaatatttgcaaaggaaaacttctgcacctttttaaaacagtcattccgcagatcggcgccgaagctgatggatgccttggaagcaaaccaggccccgccgatcccgccgcccatcataatgaaagcgatggcgatcatcgtcagccccgttccgataatatagggcacatccctgttggccgcgcccacattgataatcctggccatataggcaggcaggataacctcaccggccacctctgtaatcataagaatcggccctaaaataaacgcataccagtagggcttcacgtacttcagataccgtttcatttactgtcctccccgtccaggcggctgttttcatctgccatatttttataagcccgttccataaaatccaaaaactgcgccatttcttcatccgtaaagccatcaaaaaagcaccggtccgtctcctcgaaaataagaaagcttttatggatgacctccttccccttttccgtcacgcttacctggttgatccgattgtcggcttcatccgccagccgggtaatatagcctcccttttccagcttcttcaaagacactgctatagcggccgccgaaacatcaaacttctccgccaatcccacctgggagcagttgggattcctgtacagctccattaaaagcctgtgctgcgtgggatacacccccgtatggcagaccttcctgtccagataacgccgcagcatggtatccaccctgcggaacatcctgattgaattgtgcgccaattcctttctttccatctttttccggccgccgctcctgcacggcccctccttttctccattagtctgccagtttctcctggcaaaggttaaagttaatgtgttaacccttaatctaattaatagttatctagttaataattttaattataactataataaaagtcaagcatatctccaataataacatggaaagaacagatagctgcagcctgtgataaacaatatcaggaatcgttcttgtatttgaactagatatagtatataatggactcaattcggcaaagaaaacactacttttagtgctacagctatctcagtccgctatctgcagcagcggactgagcctgccgcaccagatatgattttaagcaagcatacataaaaaaaccgccggccgccggaatttttttaccaggcggtcccgtttaaaggagacagaaatggaaatcacaaagcgcaacggccgcagcgaaacctatgacggccataaaatcattaccgccatgaaaaaggcatttgaaagtaccggaagtaatcccgccccctccgttatggcggatctgcttcatgccgtagaggaagggctttccgaacagaatatcaccagcgtggaaggcatccaggatcaggtggagcgtactctgatggaacagggcttttttgcagaagcgaaaaattatattctctaccgccagaagcgttcccttctccgggatgccagggccgccctcagccagtccgcctccgacaggaagctggaacaggttttcagaaaaatacagaaggattttccccaggaggagtattccctcctgcatctttccgccaagtacaccgctttttccaaacctgacatgaagccggaggaaaagctgtccgctctcataaaagctgccgtggagctgactacccaggaagccccgcgctgggagttcattgccgccaggcttctcaattaccagagccgccaggccatcgatgcacgcatggaagaggcgcgcattacctgcttttatgaaaagctgcgctatctcaccgatcagggcttgtatggaagctatattttagaacaatacagccgggaggaaattgaggaagcggcgctgtttctggatgacagccgggatgagctgttcacctacgcaggtctggatctgctcctcaagcggtactgcatccgcacgaagcaccatattcttctggaaacgccccaggaaatgttccttggcatcgcgctccacctggcaatgaaggaaaaacagaaccggcttatctgggtcaggaaattctatgactgcctcagccgtatggaggtgactatggcaactcccaccctctccaatgcgcgtaagccttaccatcagctttccagctgcttcattgacacggtgcctgacagcctggatggaatttaccgcagtgtggataattttgcccaggtcagcaaattcgggggcggtatggggctgtactttggaaaggtacgcgccaccggaagctccatccgcggctttgaaggtgcggcaggcggcgtcatccgctggattaagctggtaaacgacaccgctgtggctgtggatcagctgggcatgagacagggagcggctgcggtctatctggacgcctggcaccgggatctacctgaattcctgcagctgcgcaccaataatggggatgaccgtatgaaagcccatgatatttttcccgcggtctgctatcccgacctgttctggaaaatggcgaaggaggatctgaatcaggactggtatctcatgtgtccccatgagatactcaccgtaaggggctactccctggaagactattatggcggggaatgggaaaaacgctatctggaatgcattcaggactcccgtatttccaaacgcgtcatttccctgaaggaaatcgtccgcctgattctgaaatcagcggtagaaaccggaactccttttacgttcaaccgggatatcgtaaaccgcgccaaccccaacagccaccggggcatgatttactgctccaatctgtgtacggaaatagcgcagaacatgtctcccatcgagactgtcagtacggaaatcaaatcagaaaacggggataccgtcatcgtcaccacaacccgccccggggattttgttgtctgcaacctggcaagcctctccctgggtaatcttcctgtggaaaacgacgcctgcctttctgatgtggtagccactgcagtgcgcgccctggacaatgtgatcgatctgaatttttatgccctgccctatgccaaactgaccaaccgccgttaccgcagcattggcctgggcgtcagcggctatcaccatatgctggccaagcgtcagattccctgggaaagtgaacagcacctgtcctttgtggatgatgtctttgaacgtatcaaccgcgctgcaatcgctgccagctctgccattgccgcagaaaaaggcagctatgaatactttgaaggaagtgactggcagaccggcgcctattttgacaagaggggctatacctcccccgaatgggaacaggtacggcaaaacgtggctgcccatggcatacggaacgcctatctgctggcggtggctcccaccagcagcaccagcatcctttcaggtaccactgcaggtctggatccggtgatgaaacggtttttcctggaagagaaaaaaggctttatgctgccccgtgtcgctcccgagctgtccatgaaaacctactggtattataaaaatgcccatctcattgaccagagcatgagtgtccgcgcctgcggtgtgcggcagcgccatatcgaccaggcgcagagcatgaacctatatatcaccaatgattataccctccgccaggtactctccctctatgtgcaggcctgggaatgcggagtaaaaaccatttattacgtacgcagcaaatctctggaggtagaggagtgcgaaagctgctcctcctaagtaaaaggccccggcaggcagatggctgataagcggctgaagtaaacagaaccggccatatccctgccggacagaaaggacagaagcatgaacgaattaaggaaaaaacccctttttaacccggaaggagatacggatgtgcgtctccgccggatgattaacggcaataccacaaacctgaacgatttcaataatatgcgttatccctgggtcagcgactggtaccgccaggccatgaataatttctggatccccgaggaaatcaacctttccacagatgtaaaggactatccccgcctgtcccctgcggaacggacagcctatgataaaatcctgagcttcctcgtcttcctggactccatccagaccgccaacctgcctcatatcggcgagtatatcaccgccaatgaggtgaatctctgcctgtccatccagaccttccaggaatgcgtgcacagccagagctacagctatatgctcgacaccatctgcaaccccacggagcgcgatgccatcctctatcagtggaaggatgatgaacaccttcttcgcagaaacacctttatcgggaactgttataatgagttccaggagcacagggattcctttactctcctgaaggttatgatggccaatttcattctggagggcatctatttctacagcggcttcatgttcttctataacctgagccgcaatggcaaaatgcccggttccgcccaggaaatccgctatattaaccgggacgagaatacccatctatggcttttccgcaatatcattctggaactgcagaaggaagagcctgaactttttacgccggaaaatatcgctgtcctgaaagaaatgctggaagaaggcgtccgtcaggaaattgactggggccattattgtatcggcaacgccatacccggactgacaaaggatatgataacagactatatccattatctgggcaatctgcgatggaccagtctcggttatgaaccgctctaccccgggcatactgccgaaccggaaagtatggcctgggtcagccaatattccaatgccaacatggtcaagaccgatttctttgaggcaaaaagcacggcctacgccaaaagtacggctttggtggatgatctgtaaactggagtcagcacatcagataagtacatgcgggcagaggttccttcccggaacctccgccctgttttattctcatttcaataatgcttttaagcaagctgcagcggaattctgtattccttctccgccgtcagggtatttaccacggcttccccgccatccggcaaatccggccatgtttcaatgtaaacaggcatatttctgtcgaggcggtggataacaagctccaccttctccggaaaatcaaaccttttcaacccaatctcccaaagctgtcctgtgtaaaaatgatccccttctttggttccgttgataaaaagctccaggctttcccccgtataatccagcttcaggaacacatcctccggtattcttcctccgaagaagccctgttcccggtaaatgccgtcatattctatctccacctcataccgggtactgtctgcgtccctgtattcagtcattttacaacgcaggggctgtggcttcgggctatttgatattgtataaacggtataaattccctccgtcctgcttttctcaaatccttccggactctgcgccagttccggataagctgcaaattccactgtttcattggctttcggacggtacaggatatcgcagccctgttcccttttaatcacgggatgtccgcatatgagcagatgctcttcccctccagcctctatcttccaggaatgcagcgcctcctgccttgacaggcatacaagctcgtttttccccggttctcccgtcactttgaaatccggatcctttccgtaaaagcaatagcggtttccatcgcccctgtgaagaacgcacagcggtgttgcatttgcgcaaagcagctccgcgttttctccaatgggaaaatgaaatggatagaaaaagtaatctccgtcatggatgtcctgcgcttcgaacagaatacactccccgggaagctctgcctttaaggtaactgcgttatgttccgccagcttttttcttctctgataattattgacaaacagatatccgctgctgccattccgccttactgctgtacgcaggcgggatacatcattgggatcctccggattttcctccgtaagataagtatccatcctgcagaactcttcaccgaaatcatgcagaaacatggcatataatttcagctccagcgcagtgtcggatatttgcccgtattctctgatcggcgcattaaaatcataggaatattccggaaggtcattgggatatcccgtttcccgggattcctgcagcgtacttcgctttccatggggattggtgcctccatgatacatataatatcccagcaggttcgctccgcagccaagcttcgtcaaagtcattgcgccgatatcccggttagaagccaccggccttctgtgttttgttacctggatgccgccgcccagctccgctgtcagatacgggaatttatcacatgaccaggtcaggtcctccccttttctctgatcgctgccgatattgcggtcattgcgttcccgggtaaatacatagttcacacttggctcaatctctgtgattcgtggatcccagggcgcatcgcaataacctcccagcaccggcaaaagcccgccggttgccgctccgccccagccagtcgcggtataatagggtacctcaaagccggccttcacagccagctctttcaacctgcgcatgtgcgcttccccgtcttctgcctgcagcccgccgcagtgcccatattcattttcaatctgcactccgatgatcgggccgccgtcctttaaaagatatccttgcacctcttcaaaaactctattataataagcttctacacaggcaaaatatctctcatcattcgtacgcggctgatattctttctgcagcagccagtctggaaagcctccattgcgtacctctccgtggcaccacggcccgattctcaggaaaatcagaaccccgcatttatccgcagctgccagaaatttccgaagattcctgcatccggtaaaatcatatcttccttcttcctcttcatgatgtatccagattacataggttgataccacatccacgccgcaggctttcattttatacagcgattcctcccagtaacgatccgggtatctgctgtaatggaactctcccatcaccggaaaccatggtctgccgtttctggttaaatactccgaggtccagccaaatacttctttcgcattcaaatgcttcacctttccttctactgcagcgacggccatgcaaaatcaatgcccaatttttgcttattcttatggaatttttcattctggaactcatacagctggtcaaatcccatactctttatctgatcgattgcctgctggtaaagcttctcgcattcttcctcactggaagccataatcatctgaggctcggctgatttccaatattcatcaatcgatgccttaatcgctgccagatccgttcccgccatcgggttaatgtctgaaaaacacttgtcatcatacaactgtgcatctttatcgcgctccatattgatacggtctttttccagctcattttcaacattcagattctcatatttctgaatgatcgtataatccatggcaaaactcagattcatattatatttgttataagcggcgttataatcgtcttcatattccttcaccgcctcttctttccttatggctttgccgtcaacaatatcataacagccgcagccatattcctcatccagagctgcttcttcctgcgtcaggtaggagaataatgaaataatcctgtccggatgctccgcactttttgtaatcattgtggttgtccagcctgccgcattaatggatgacagatagtgctggttgcccgaatcaccggttgtaatagagccgcagtaaagcattttcgcattgggatcgctagaatagagagcggatctcggctgcttaaccgtcatccagccctgcgccataaatacctggccgctggccaccttctggtcacgctgtgtctgatcctgggtaaattcatctgtagtaatcaggccttcccggtacagcctgttataaaacttcagagcttctaggtattccggctgcagcttgatatcctgaaggttcccttccttatcctccagctgcgcgccgaactgctgcgccatatttgtggcataaactcctgtcagaggtattacatccataccgtcatactgaagcttttcgtctttcacttttttcagagcctcataaaagccttcctttgttttcagatcctccattgacattccgatctgctccagtaaatccgttcttacgaagttactgttatgggtaacaagaaatcctccgaattcatcagtgcatctttccggcccatagtaaaagctgaccagggaataccattttccgtcatcattgcggtaccagtccttctgggactgcggcacattcaaatcaggcgcatacttttccgataattcttccagatccagaaccatcccggaatcctccatctgaagcctctgtgaagccaccgcgtcaaaggtaaccacatcgggcagttctcccgatacaatcagcgcattcagcttgtccgcattaccggtaattacattaatcgtaattcctgtttcggtctgcagcttcttatccgccatattgtttacaggatcaaataccttaccataccagtcatatgccacaaaccagtcaatggtgatggggctggtatcctttttccagctcggtgtctctccggccgcctctgcggattcctctactgccttctccgtgctttcctgttcccccgtctgcgcagcttcggacgcagcaggctccgacggcgcattctctgtcttcgccccgcagcctgccagcatgctcacgcacagcatacctgccatgacggcattccataatttctttcctctcataggaaacctccctttaaaaatttattgttgtagttatcccttcactgctccgattgtcataccctttacaaagtatttctgcaggaacggataaatagctaccaccggaagcgccgtaaccgccatagcggccagcttcaccgactgtgcggtaattttggctgccgcgtcaggcaccaccctggccgccgtagcccccatccccgccgcaacggacggatcggtaattacctttttcagatacagctgaatcgtctgcagggacacatccgcagtatacatcatggaatcaaaatagctgttccagtgccccactatcgtaaagagagcaattgccgcaataaccggcttgctcaaaggcagaataatctgcaggaaaattcggtattccccggctccgtccattttggccgattcattcaatgcctcgggcagctcccgcataaaagactggatgatgatcatattccatacattaaaaagggacggaataatatacacccagaaggtattgtacaaatgaaggcttctgatcagcagaaaataaggaatcaggcctcctccgaaaaacatggtgaacataataaacggtacatatattttcttgaatttaagattcggcctgcacagcccgtaggataccaggcaggtaaacagcacgctggtcacggttcccaccgcacacttcgccacggtaactgcaaatgctccgataatgcttctgtcccggaatacggccttgaaattatccagcgtccacaccctcggccacagatagacgccgccgcgcatatagtcttttccttcattaaaagcccctacaataataaaccacaaaggataggccataataaaaatgaaaattatcattataataatattaatcacatcaaatggcttaaccctgccaacctttctttcctcgtccacactcatcccgccttccttaaaaaagtccttttccggttatcttattagagctcttattggctgcccacaaaaggattaccgcaattactgatttgaacaggcccacggccgtcgcataggaataccgctgctgcgtcatgcctattttataaacataggtgtcaatcgtctcactcgcgctgatattcagcgaattctgcagaatcagcacctgttcaaacccggtattaagaatattgcttatctgaaatatcagcatgatgacaatcgtccccataatggccgggatcgtgatatatataattttctgaaacctgtttgccccgtcaatgtatgaagcttcgtacatgtcctgatctacagaggtaatggcagatatgtaaagtatcgagccatatccgatgcttttaattactgaaataatggtgaatatcatataaaatttacccggatcagccatcaggttcagactgccgtccaccagatggagcgtgttcagcatcttattgacaatccccccggaggccagaagctcaagcatgatgccgccgaatataacccaggacaggaaatgcggaagataggataccgtctgcgccagcttccggaatcttttccctctcagctcggtaattaagattgcaagcagcaccggcgcgggaaagcctatcagcagccctagaagatttatcataaccgtgttcttcagaaccagcggcagctgaggatccgtaaggaactgacggaaatatttcagtcctacaaactcccctccggcaaagccggacataatattaaaatccttaaatgcaataatgatcccgtacatgggaatatagctgaatataaacaggaaaatcagccccggccaaaccattgactgaatttccagctgtccctttaacctgtccttattccaggtatgtactttccctgctttaccgcccattttcttttcctcctgatttcgtactgttcttcctgatgccgtcaggccgcaccctccagcaatgccatcagtgccgcctgttccacgcccattgccctgcagatacagagcagttcacttccgctgatagtatcctcccccaggaaaatcattagaatcctctggtaatcaatcccggtcagatgcgccagcatgctgcagtttattttcttttccgtcatacagtccgttaaaaaccgtatcagctttttgttcatatttcctccccttaaaatcgattttttcgctcttttaccattatataatcgaattattcgtcttgtcaacatatttaattcgaatttttcaactaataaattgacttgtatcaggcaatcctgtattatgcagttgtgaggtgacaatatggcgaataaacagtttggcaatactcttcgtactttacgcaaggccagaggatatacacagcagcaagccgccgatctgctcggcctgaagaataaaagtaccctggcttcctgggaggtcggcaagtctgagcctgacggatacacatttttaaagctgtgcaggctgtacggcgtcagcgatatttacagtgctttcaatgaaatgcccccgacagcgcaggttaccaatggaattctggaaagctacacactgctgagggatgactataaaaaaatgattgataatatgattttccagctgctggatattcaggaaaagcttaaataacagacttcgctttcagaaatcatgttcccggggctgagctttcagggaatcagaggccgggattccggcaaaaaagaaaatggaaatgaacagagccttctcagcgccgccagcagtgtacatccctgccggccgagctgagaaggctcttgttatattttatatttcattactattgccgcaggtttatcacctgcggattacccgggccgtatatttcttccaatgtaattaatgtaacccgggccacgcttcactcctcgtccttcaccgcccccgcagctcattcacctccattttattcacaattccttccgcagtcacacccggatgcgtcacccttatccggcatacctgctccacaaaatcctgcggcagcttccattttaaggacatttctgcaattgtttcccctttgtccattcccctgagaatcctgccgaccgcttttctgcgatccgcttccggcggcatgctttccctgccgccggctgccgggcttatgttttttccgtattctgcgttttccagatctatccgttccaccgcagctatttttccgtccagcagggtaacggccgccatggtaagcggaagcctgaatcttcttttcccgcagctgcccggattcagccagcatcttccttccgcccattcctcactgtatttatgggaatggccgaaaatcacaagcttcacattctcccctgtttcccggatatcttttctgttatggatcagaaaaatgggaacgccctccagttcaaaccgcagcgattccggcagctgcccggcccagccgccgtcattgttcccccgcaccagataaaggggtttttgccccttcagcttctcataaatgtccggcgtatccacatctcccgcatggatcaccgcatcacagcccccaatcaaatcaaccgtctcctgcctgagcagcccatgggtatccgctatcaccgcaacccgcatttcctgccacctgccttcccaccatcgatccggggcagttttcaagcatgtaccagcccccggtattccctgtgaaatccatagttctcattttccgctttctgcaggccgcccctgtccatgagggcctgctccgcataattctgacatccttccgtcaattcttttttcatcatacctctttctgcatttgggaacaataagaatccctttatcttaaaaaaatattaaacgcctcccctttcccaaaactggcatggttaaaaagttgcaaaatggcactttctatcatgccacttttatgtataataaaatgcaagcaattgcaacaggaggtaaccgcatgactgaaaacagatatgaactgaataaagagctcgcacagatgctcaaaggcggcgttatcatggatgtcaccacgccggagcaggccaggatcgcagaagcggcaggcgcctgcgccgtcatggccctggagcgtatccccgccgatatccgggcggccggcggcgtatcccgtatgagcgatcccaaaatgatccgcggcatacaggaggccgtatccatccccgtcatggcgaaatgccgcatcggccatttcgcggaggcgcagatactggaagccatagaaatagattatattgatgaaagcgaagtcctctccccggcagatgacatctatcatattgataaaacggcgtttcgcgtcccttttgtctgcggcgccagggatttgggagaagcgctgcgccgtatcagcgagggcgcatccatgatccgcaccaagggagagcccggtaccggcgatatcgttcaggcagtgcgccatatgcgtaaaatgaacagtgagatcgcccgcatcgcctcactcaggccagacgaactgtttgaagccgcaaaggagcttcaggttcccttcacgctgcttcagtatgtccatgaaaaccgcaggcttcctgtggtgaattttgcagctggcggcatcgccacccctgccgacgcggccctgatgatgcagctgggcgcagaaggcgttttcgtgggctccggcattttcaaatccggcaatcctgccaaacgcgcggcggccatcgtcaaagccgtcaccaattaccaggatgcggcgcttcttgcctccctttccgaggatttgggcgaagccatggtcggcatcaacgagtctgaaattcagctcctgatggcagaaagaggaaagtaaaggagccagagccgtgagaataggaattctttccgtacagggcgctttcctggagcatgaggccatgctgaaaagcctgggcgcccaatgctttcaaatcaggcagaaaaaagacctggcggacggaccgccggatggccttgtgcttcccggaggcgaaagcaccgttatgcacaagcttcttctggagctggagctttatgaaccgcttaaggaaatgctggagaacggtctgcccgtcctcgcaacctgcgccgggctgattcttcttgcccgcaaaaaagaggatggcggccccgtctgcttcggcacactccccgtcactgtccgcagaaatgcctacggaagacagctgggaagctttcgtaccgaaggggactttaaaggaatcggccccgtccccatgacctttatccgcgccccgctcatcctgcgcgcttcgccggaaacggaaattctggccgccatacaaaggccggagggtgaacagatcgccgccgtacgctttggcagccagctggccatgtcctttcacccggagcttacggataaccctgccgtccatgcttttttcctggatatgataaaaaagtaccaaaaccgttaatttgaggaggagacagttatgagaaatgaaaaagtacagaagctggtaatgacaggcgtatttgccgccctgtcctatgtggtattcacctttctgcagattaaaatcaccctgcccggcggagatgccacatccatccatctgggtaacgcggtatgcgtccttggcgccctgattctgggcgggctttacggaggcatcggcggcgctctgggaatgaccatcggcgatatttttgacccggtatatgtggtatatgcgccgaaaactttcctgctgaagctgtgcatcggcctgataaccggccttatcgcacataaatgcggcaaaatcacacatatcagcgataaaaagaaaatcttccagtggacgctgtttgccgcaatcggcggcctcgcctttaatatggtagcagatcccctggtgggctatttctataagctgctgatccttggaaaacccgcggcggacatcaccctggcctggaacatcgcttccacctccatcaatgccgtactttccacaatcgtagctgttgccgtttatatggccctgcgcccggcgcttcagaaggcaggccttttctttaaaatcgggaaaacagaggaagcgaaataattttctgaactaaaaaataatttcttaaaacaacgacattccggtagccggagtgccgttgtttttgttataatagactggttcaggcaataatccacccgcctgcggatcagttgtaatgccgcaggcagcttacggaagacatttcccctccgcgctgcctgcattataataacaatattttcagaaaaggaagtataattccatgacagttcaaaacatgacggagcaagcacgaatcagctgcggaattccgaaaaaaatagccatgatcaacgatattgcaggctacggccgctgctccaccaccgtctccctgcccattatcagcgccatgggagtccaggtctgcccggttcccacctcagttttttccaatcataccggctttccggttcattttatgcacgactgcacccctatcctgccgcagtacctggaaaaatggcaggagctggagctgacctttgatgggatctactgcggttttcttggcagcgtggagcaaatcggaatcgtcagggattttcttgtttcccagatagaaatacaggagtcgaaagccttgtcggcacggcccgcagtaattctcgatcccgtcatgggtgatcacggaaaagcctaccgcaccgtcacccctgagcactgcgcacagatgaaggagcttctttccctggcggatatcatcacccccaatattacggaggcctgccttctggcggacatcccttaccgggaatccggctggacggcggaagaactgacagcgctcgcggacaggctgcatgccatgggaccggatcggattgtgattaccggcatgcaggagcaggaagatttcattaattttatctcctgcaacagcggcgcagccacagctgatgaaaatgccgcaaaggccggccgccttcacagctgctgccggatgcacgccgcaggggaatcccgtccgggaaccggggacatttttgcttccatcatagctgccgacgctgtaaacggcgtacctttccccgcttctgtggaaaaggccgccgcctttgtccgcacctgcaccaaggcatcctctgagctgcatattccgcagccccagggcgtctgctttgaaaacttcctctatctgctcacgccgcctgcctgccaaaacctgctgacgccgcctgcccaacatgacggcgcctgcccaaattgattttcagtgaaaaatatgctatcataacaactgccccgccttccatgcaaacaggatcgtcccataggacgtttctttataaaaagaggtaaatgtatgaacaaaaaagaagtccttgaaatcagaaagcagtatacccacgaaaaatgttccatttcccgtatctgcggctgctacgtggacggagaaaaaaacatcaaaacacagatcaaggaagcgtttctttcccttcctgaagaagaaacctttaaatattttaatattttcaagcagaccctttccggcactctgggaaaaaatctgctgaacctagaatttcccctggatgcggaaaatccgggaggcccccaggaatttttgctgaagctgcgtgacagtaagctccaggatgatgtcctgctggaggagttttaccagaaagtaattgaaaactactattttccggaaaattattacatcatcctcatccatgtggcttacgatattcccggaaaatccaccgatggctcggaaatgttcgatgcctccgaggatgtctatgagtacctgctctgcagcctctgtccggtcaagctctcaaagccgggccttttctacaacacggaaaccaacaatattgaaaaccggattcgtgactggattgttgacccgccggccaagggctttctgttcccggccttcaacgaccgtaattccgatatccattccatgctttatttttccaagcaggcggaagaactgcagccggagttcatagagaacatgtttggctgcacgctcatccctctcacggcagaaagccagaaggaaacctttaattatctgattgaggatacgctgggtgaagactgtgattatgaggtcgttaagaatatccatgagcatctgacggaaatggtggaggagaccaaggattctcccgaccctctcgtgctcaccaagccggatgtaaagcgtcttttcgagctgagcggcgttcctgaagaaaaaatggaaacctttgaccagacctttgaagccgctgccggggaaaaggcctccctgcttgccacaaatattgccagtgtccggaaatttaacatcgagacgccggatgtggtgattaaggtcaatcccgaacgcacggatttaatcgagacaagaattattgacggcaaggaatgcctggtgatcacggtaaatgatcatatagaagtaaatggcgtgaatgtacggaccattgctccccagagggatgaggattatgaggaagaatttgaagaagccattccggcatccgctcccgccgcctccgacgctcctattgatttcggagccacacaggcatagttttaatcaaacgaaaatcattcgtgtccataaatatataaaaggcgccggcaggatatttttctttatcctcccggcgccttttaaataagcgctactccgtatcgttttcctgattttcgtcctcagccatccgatagccaaccccgatttccgtcaggatgaactggggctctgccggatttttttccagctttctgcggatgttggccatattcactctgagaatccggttgttatcgtctgcatacggcccccatacatgggaaatgagagtgtcataggtcatgacccggcctgcattcctggcgaggaaggacacgattttaaactccacctgggtaagatggaccgcttccccctccaccgtcaccagacgccggtcaaaatcaataaccagccccttggccttataagggcggtcaaccattgcgctccctcctaccgggcggttcccgtgccgcaacgcagtgcggattcttgccagaagctcggaggagccgaagggcttggtaatataatcatccgcccccagatccagcgccattactttttctttctcctgcgttcttgcggatatgacgattatgggaatggccgaataggaacggacctgtcttataacctccatgccgtccacatccggcagccccagatcaagcaggatcacgtccgggcactgggaggctgtgagggaaattccctccctgccaaggcccgttgtaatcgttttgtagccctgcgccttcagggtagttgctatgaaatcacatatatttttttcatcctctatgataagaatggttacctttgcctgcattgtttttctcctccgtcagccgtagctgttcatatagccaaaccgctaccgtcagtcctcatttgcttctcccctgggcagggtaaaaccaaactgcgccccccgttccagattcctggcgcttatggtccccccatgggcaactatgatcgtcttgcagatcgacagtccaattcccattcccttgtgtccgtcagcgctgctgttttccgtctgccctgttccgtcaaaaatggtttccagcttatcctcgtcaattcccacgccctgatccgtcacaaaaaaagtaaccgtatccctgcctatttcggcgcggcattctatcggctccgtacttcccgcatgaaaaaccgcattttccataagatttaccagaacctgctctatcagcgtcgcatccatgggaatcatgacaaattcctccggcagaagcacccttatattggcatccggtattctctttttcagacggaatacggcttcggacataacctcctccaccggctccaaggatttgttcacgctggcggaatcatttctgatacgggtgacagtcagcagattttccaccatattcagcagccagttggcatcctcgccgatatggctgaccagcgcccttttttcatccgtatccagcttttcctcgttttccagataggagctgctggcgccgataataccggtcagcggagtgcgcaggtcatgggaaaccgcacgaagcagattggcgcgcattttttccttttcggcctcagccagcattttttcacgctcggccagaatcctggactgctgcttcatatgggatgcggatgcgctggttatcacagagaccacaagcatacagataaaggtaaccgggtatccgtccagcgtaaaattcagctgcaaatagggataggtaaaaagataattcacgcataccacgctcaccatcgccgctgcaatccccggcagatatccgctggtcagccgcgaaataaacagcagggccagggtataaaacatcactacattaatattgctggccgatattctgtaatacacaaaagccgcagccgtggctatgaaaagcactccaaaggtaattgccgcatccttccatgtacactgccacagctggttgagaaacgctgcctttcccctccgccagccgccatttttatccattgcttttcctccgtcctgtgtcattgcatacgcaattattatacgttcagccgcgccgctttgtcaacggccgcaaaaagcgtactgccgcaaaaagcgtaccggaaaaatggatctcaaaagcggaccacaaaagcagaccgaaaagaaacggaaggccggagcttatagtttctccccggtcttccgcttctttattgatttactggttctgtaccagaatcttctctatttccaccacatacatggtatggaagtccttctgtgcataatgctgcgctgccagctctttgtccacaaagctttcttccgtcatcggctgttcataaagcttccggcagataagagccatgcggctttccttaaataccggcgcgctgttgaccatttccacatgcaggccgcttgccgcgatcttatcctcatcccttcctgatacggttcccatataattcagcatcttacgccagctgtcatcaaaaaagctgagcgagagcttatcgcttttgtctataaattctttggtgtagcgctgaggccgtacaaatacgaaggctaccttcttgccccataaaatacctacgcctccccagctcgccgtcatggcattcgtcctgccgccatcctcggccgctaccagcatccagtcatcattgatgagatggaaaacattctccgtcagttcttcaggtttgatcttatcccacatgcttcattacctcctgtcagtctcagccctccggcatgataacggctacgatgaagtaagcaatcagtcccaggaagcctgctcccaggaaaatactggccgctatccatataattcttattatcgtcgggtcccagttaaaatattccgcgattcctgcgcacacaccgcataccattttattggtagtggatttgctcaggcgtcttccgggctggcgtccgctgttgctgtagccgccgttataaccgccgtttccgttaaaactgctgccgccattataaccgctgttgctgtagccgccgttctgccagtcgttaccctgctgataagagccgttattattattataggaattaaaatttccattgctgccatattgatccgtgttctggttctgtccctggttcatattttcattattattgtattcgtccataatttcctccaagttccgccgttcaaatcggctgccgctttcttatattatcgttcatcattccggatttgtaaagtaaatttctatctttcccatggaactggataagtcaaaataactgtcagctccgtaattcaggcttttctcggaagacatcccgccgaattcattatctccgataattacggttcccatagatgcttccacttcgtaattatgatccttttcatatccgtccagccgcattgacatacttcccattccgcagctgccgtatacgtccccggttacgcttccttcatattccatgctgcccataccgatgtcaaaattcatattttccaaagcagcttctttaaggacaagcttacccattcccagttcgaaataggtatccgtcgcttttaaatcgtcgaaggtcaggctgccggcgcctaccgtacatgtgagactttccgtatccatcacggacacttccgcttcccccgcgcctatttccataaccgcatccacaaaagcgcaggtatcaggcaggtaaaggtatactttggtggccgtatctctgattttgtccatatgctccatgttgtgcctgtcaagcgccttgatatagagcgtaccgtcttccaggaaatactgaacttttttaacatttatgccttccagatgaatattgctgtccggggatttttttacataaaatccgacgccgcccatatccacatccaggtaagctgctgtctgagaggctgccgaataaggaatcgtatccttaaaatcagccttgtgtatcggatagctgctgtcaaaatccacgctgtcgcctaccgtaaatccattgtaatcctcatagtcatcataatcatagtcacctgaatattcataatccacatattcatcattataatatccgccgtgccagccatagggcatgttcacaaagggaagatccaggtccccgtttttgtacatttcatccacctgcgccctgccgccggccgctcttcccgccatcgccaggacagcccccagaaccaccattaccagcgcagcgagtaaggatatttttaaaaatttattcattttatacctcccgcatatcgcaggtctgcctgcgatactgcatcaattcccatccgcccgcttccgcggacatatgattaaagtcactcctgaaccaggatggccgaaagcgctttcccttcagccattgcttccttaaatttatgctgcatttcttctggtaaaaggccatctgcacagatttacaaagcctctgcacattaccggcaccactttgactaccagccatatcattcctgctgtcatagccaggccaattccggtacatgccagtccgccgcccaacagataaagcgctgccgccggcataaggaagagcttaagaaacgcggtgatgacaagtgcgattcccacgataagaatgaccactcctgcaaccaccagggaaccaagaaccgcaatgaccgataccaacaggctgaataccaccgctactgccgcgatgcccagcggcaggatgaccggaagggcgaagatgcacagcagaacaattaatgcgattctgccggcactgcttttcttcttaggcggctgatggcagccgtttccgtactggttctggtattgatactgattctggtattgattgctgtactgattctgatatccgttgggaccgccctgattctgatagccgttgggattcggggctccgttaggattttgatactggtagctgttctggttttgatatccgtcagggccgctctggtactggccgccattctgattatgatatccgttctggtatccgttgtaattctgatacccgttctggttctgatacccgccctgattctgatatccggcaaagttgggaccgccattgggattatgatatccattcatgtcctggccgcctgcctgattctgatagctttcaggcttcggtccggcgttttggtactggccgccgtactgatttccataactgttctgattattccggccgccacttgcctggccctggccgctgccctggtacccctggcctgcctgcgcagaatccatattctgctctttgccgtgaatctggcaggaatcgatatccttgtaaaggccgcggaacggatcgggattgatatccacaaagccttcctgagccttctccggctctgagctgtttgccggagctgtattttctttttttgcgatgtccatatttgcgctattgctaaccaagccattactgccagctccattgctatccgcgctgtcacagtcggccgtcaccacatccaaatccattgcatccgtattcactacagccgcatctacaacctcagcattcatgatttctgcgtctaccgtctcaatatccgcattggctccgccggagcttaatatggcgtcaaacacaccatccgtatttccgtctgcgaacctggtttcttccgcagccttatcgtcttctgaagaagcttcaccgggaagaatcatcatatccttttcttcattattcatatggaagccgttttccataaattccccggcttcatttccctctttcaggccttccttaatattggcagctacctgtatgggtgaacccagtgcccggatggcagactcttcattttcaattcccgcgtcatccagataatcattatagtattgcagcgcctcatcccgttctgcctgggaaatgtccgaaaggagcatttccagctgattcataaattcctgtctgttcattgattaatacctccctcgaacattcctgttatcttggcggaatattttttccattcctcttcatataatgcaagctgtgccattcctttttccgtaactttatagtaacggcggttcctgccggcacattccatatcataaactgcaaggcagtcatccttctgcagtcttcttaataccggatacaaggtggactccgacagctctattacctgccgtacttcctgggttatcttgtatccataggttccttccggttccttggagacaacagcgagcacaattgcatccaacaatgccgctcctgtattaaaaaccatattgtacactcccttccattgggacttatgatattatatgagatataatattgttctttaggtatactatattctatatactataaacagtcaaggaataagcagggaagaaacagcgaaaaattgtggataaaaaacgaaagaaattcttaagagggaaaatgcctgttttccgcgcaggaagtgtatcgggaacgtattccacgactttcctggcgtattaacaagtatcctttgcataaaaaaagcacccgccgggttatttccgacgggcgccaattctttgtggtactttctggtattatgtcttaaatttcagtacttgtttttgaaagggaaattatttttcgccttttttccgtctcttggcggtaattcccagggtaagaactgcacccataatcaggaatgaccagcctgcgattggagctgtatctccggttccaggtcccttgctttcgccaagaactcctacctccggtcctgccgcttcacctaggactcctacttcaggctgtgcgggaggaagtgcctcgccgagtactcctgttgtagacggtgtcgtgtcaggggtcggattcgggttagggttaggatcgggattctcaggagtaggagcagagttggctgcccactgtgcatatactgacagtccgccttccaccatactcagcgtgttgcccggctgatatacagcagaaccctgcgcatcaattccccagcctgtaaaatgatttccatccttgctgaatccgtttgcaagcaatgtcacatcataatctacaggataaatattggtatctgttacactgccgcttcctccattgccataataggtaatcggatattctttataatcaggcgtatcatcagggccgccatccggaccattttcatcgatagcccataccgcatatactgtgatatttgtctcacccatcctgattgtacttccaagaatatttgccgcagcttctgcttcctggctttcaacaagcgctgtcggagcttcactccatcccaggaaaactgcattgtcacgatataactctcctgcgcccattaaggtaatatcagcatcataatcgtactgattactgtcttcaggcacgtttccggaaccgccattttcgttgtaggttatgctacctgttacctttaaggtaccgtcggctgtaataaccgtatagtaatccgttacgtcctccgtaccattcatgatggagacattttgaaccttatttgcgctacttcctactattgtctgacttccttctactgtaaacagcagcgtatcagtgtctgccagaagctgatcctctacatcggcggaggcctttgttaaagcagttccatcatacggctttgtatcgcttgctgcagtgattgtaataatacgtttctctgcttccttatttgttacttccagattcccaaatacagtcgttacttcataattatctgcctttgtattatcttttaatgcgtaagtaaatgtattttcagaagttcctgcaaaggtttggcttccggttacatcataagctgcaccttcaccctttacaaaatcatctccacttaccgtaaccaagtcattagtcagcggtgttccgtcatattccttgctgtcacttgctgaagtcagtataacatcacgctgtgttactgtaagcaggccatcctctgtatggatactgccgtagctgtcagttacatccttggaaccgcgcattactcttacacttgttaccctattttctacacttcccacatctgtaatactgccggccaccataaccaccagttcatcaccatctacaggagcctgagagcagctgtatttattataaaccaattcggtgccatcgtatttccttgtgtcacttcctgccgtaactataatctgcgttttgttttgcgtaacttcaagaagaccttccactttgtcaatatcataatttccttccctggtacctttattccactcaacttcaaaggtattccaggagtttcctgcttccgtttgacttcctgttacattaaaggtcactccttctccgtctgcaaagccatctccgcttatcgttacgtttttgtttatcagaggtattccgtcatattctttgctgtcacttgctgaggtgaaagtcactttacgttctgttacggtaagtattccatctattctggaaatattgccatagtagtcggttacattctctgaaccacgcattatcttcacttcagttacaacattttctgtcttaccaacatccgtaatacttccggaaaccataacttcaatcgtatcaccggctgcaagttcacctgtcttactgtaggtattcttgctgagcggtgtaccatcatattttttctccgcatcagatgctttaatgatgatttcggtaaggttctcagtaactgtcagcgtgccttccttcttcgttatactgtagttttccggctttgtttttgcatttaatgcataactgaaagtattaggtgaacttcccaaaagcgtctggcttccggtcacattatacgctgcgccttctccatccgcaaagccctctccacttactgtcacagtatcgttggtcagcggggttccgtcatactctttgctgtcatcagcagatgttaatgttaccttacgctgttctattgttaaggttccatttactgtgattatccctttatagctctttgtaacatcctcagagccgcgcattaccttgtaaccggtaattacattatattctgaacctgcatcggttctgctgccttctaccgtaacctcaagcttatcatcacccacaagcttcccggtataggtatatccactattcgtcagcggttttccatcatataccttactatcgctagctgcggtaattactatgctttcctcagaaggtgtaacagtcaaatctccttctaccgtactgatattgtaattaatttttaatgttccatcatttaagctgtaggtaaatgtatttttagaagagcctgcaactgtctgacttcctgttacctgataggtcgccccttctccttctataaatccatctccggttacagttattgtatcattagtcaatggtgttccatcgtatactttggtatccgttgctgaagtcataactatatcacgcgctactacctcaagctcaccattttcttttgtaattttactataattttcggttacctcctgggaaccccgcattactttgacacttttaatttcatttactacagtgcctgcattggtaatgcgcccctctatcataaccacaagcttatcaccggataccggtaatgaagaactgctgtacgtattgcaggttagctctgttccgtcatacttcttgctgtcactccctgctttaatatgaatcggggttgtgttctttgttacttgaagatcacccggtttacttgtcacttcataattctttttcttggttccttcattccaaatataagtaaagtaattcttagaagttcccgcatctgtctgacttcccgttacattgaaggtcatgccttcgtttcctacaaagccatctccgcctattgttacatttttatttgtcagaggtgttccatcatactctttttctgctgagcctgatgtcaggataactgtgcgtggagtaactgtaagcttaccattaatcgtactaatcttaggataacttgctgtaacatctacagtgccattcataacctttacactggttattttattttctgtatctcctacatctgtgagttgtccttctatggttactacaagcttatcaccagatactaaagttccctccactaaattatatacattgtaggaaaaaggtgttccgtcatacatacgtgagcttgtgccggctactactttaaattcaccacttaccggatcaaccaccagctttcctaactgtatatgaatatcatagtttacagcctttgtaccttcattcaaagtataggcaaaggtattctcagattctcctgccactaactggcttccggttacattaaaggaaactccttcaccatctgcaaagccatcgccacttattaccacgttgctgttagtcagggctgttccatcatataccttataaccgtctccggatgtaaaaatcacactgcgcttatttactttaagttctccgggagcagtcgtaatattatactttgatgttacatcaatggttccatcactggtggtacgcgttactttatagctttctacttcattcacacctgttttgtctgcatctgtctgcgatccgacaactacagccgtcaatttatctccaggatgcaaaattccctgagtgtaggtatagccattatttgttaaaggcgttccgtcatacatcttctcatcagatgctgcagtaatggttatcgtttccgtagggaatacttcttcccaggttgccgtaaatacgagatctccataggaacctgtggatataacagtatgcatcggatcatgcggctctccgtcagtatcttcaacgctgcaggtccatccggtaaactcaaaataaggcttgcttggattaacgagagttatatccgcatctgttgttttgtaggtggagggattgggattcgtgcctgccccattccaggttgttccctctacattaacatatgtgatgttataactctttgcagtacagttaaatacaaactcagtaacttccccgactgtcatattttttgttattcttgtaggtgtaataatatagccaggggctttttttgcatctgctgccactgttaaaatattgtcctttgttgttaaattcccggaagaataaattacgttgttattatcatccacatatttggtaacatactggaattcaacagaacctatcttataatagttgaaaataattacattattttccgcttctgcagacaatacgatggatttcgattttgcatccacaaaatacccatctacattaatcgccttcgctactacattgcttccaaccttgccgctgattggagctgtttccggataaacaggatttccggtattcttatccagataacggacaatataggttgtttctgtatttgctttccaatgtgcatagatgtttgtattttttgtaataggctttgcgaagtcaaatagctttgcatcgggtgatgttgactcataccagcctatgaaggagtagccgtttcttacaggatctgtatagggattaactgtattgcctttctcgactttatctgtatgtaatgttttgccttctgaaatgaagtttacatcgtattcaggggcaatccactttgcatataaggccagattggctttgggcattgtcatatttaacaattctgccggttttccctggaattcactattactataccaaccaccaaatgtatagtcttcttttccagacggtttagacggaacataattattatattctgccaaagaataaccatattttacggtttcacttcttatcggcctggaggattcattataaaattccaagttgtagtaccttctgtcataataaaaatagtaatgtcctttagaattatacttataatatgagtttttatcataaccttcaatttctttttgactcaaactaccagaatgaacttcagatatataggatttgtcttcttcatatttatccctgccactataattttcagaatctattttttcaaataaataatgacctacaacagtataatcactaccactccatgatgcgttgaaaattctatatccgccatctacttgctctgatgcttttttgggtacctctgcatcaccaataagcaatcgttttgttgctatactatccccccaatttacgaagtaacattcatagtccctttttccatatgtatatgttcctgtcgtttcttgagacgcaggccacaatgttgatacatcctgtccatacttcgcttggaaaccgtaactaccattatatgtctttccaccaatcgttacattagatgagttataatcggtaccacctattcgtatatttcccttaaccttactatcgccataataagtattaacattaaaaacaaaagtataaacatttaaatcataatatacttttacttccgaacttccatcagcagcagcgatcactttttcatatccactataatgatagtgcttttctcccagactattattttctaaataataattgggtataacaatctcttctccagctttcgcattacctgaatatgccgatataggaactgttttaacatatttatcgtgatttccttccggcccatttacatcttcagccatatatacaatactatatccaacagatttggcttcccacttagcataaagtactgtatcttccttcaattcaatggtcctgccaacttcttttgtaaactctttatcaagataccatccatcaaaggtatatccaacacgcgtagttgcatcatttccctttacagtcattacctgctcatacttaccggattcacgggccacataggtaccgccattggcatcataggtcagccagtaagtatttctgtcatacttaatcgttatgacaataccatcctgcgtaagaacttcattagcaatctcttccggtgtaaaaccatccactgcaactgctttcgcttcggttaactcaccataatcgccgctgaaggtttccgtcagactatcatcaaccgtatactcggttccatctgccttttcaaacgcatgctttaccgtatactgaagctgttttaccttataaacaacagtgatttccctgcttcctttttcactgtagctaccgttcaggctggttccgtctgcggataatgttacatccgtatcagagatggtcggataatagccttcctgcttcggtacagatatcgtatatgtattcttggaagaatcttcatcaatcagatattttgccgtaaaatcatttgccacggaggaaccgtcctcaaaagagaacttcactttcagtgtaaaataatctccttccggtacgatatccggattatcttcatcaagatttcccagatatatggtacggtaagaaggcctgttatcaacgatcttccacccgtctgctactttgtaatgaatttcagcatatcccttaccatccttatcaaaatcttcttttgtaagggtttcggcggatactaataccataccagtacgcttaaattcatatttacttacatctatcttcccgtctttgaaatctgcttctgttaattcaaccggtgcatctactctgtgataccttcctctatttgtatcaagaaaatgttctacatacagagtatatgcaatttcttctttttcaggctcttcgatattgacattaactgccgtatcggacttgccctgtaccgtatacactccatctgctgccgtcagttctttgtcatccattttaattgtaaccttgctgtcggcattctccgcttctaccttaaagcgaagttcttcattgacttttccggtcaagctattgatttccgttccttccgtatccgtaactttaccattaccggttatctggaatgtaattgtatatttttcttcttttacttctgactctgtttcagcaaatgttaccgtaatcttcttatctgcatcaaaggctacttcataggaaccgttcgatgtcccgatttcatttccgtctactaatatggaaacatcagtaccttctgcttcaacattgaacttatagacgcttccggtctcaccggttacagtacttcccacattattgccttcttcatctgttacactgcctttaccgcttatatcaaaggtaaatgtgaaggtttcagcttttgctccttctgtttcggtaaatgtctctgtttcagtctcagtagtcacttccgtagttacctctgtcgaagtttcttctgttccttcttcagttgtaacaatatcttctgtactaaccgattccccacttgttcctgtttccgtactggattccgattccacaacactttcttcggttgagctctcactgctgccgccagaggtgtttccgcctgtcttagaaccttcctctacctgaggtgtttccccctgctgttcagtctcggccgtaaaagctgatcctcccttattggatgtctgttccgctgtttttggatcgcttacagtctgttctgtcgtagtttcgccctcagccgcaacgatactcataccgtcactggctatagtcgtactgacaagaacaaaagccagtagaaacgcccaaaatctttgcaaatgctttgccttcttcattttttgtttctcctctccattttttataactcactaaacaaaattaattaatcatctttcattgtttcatctcccagggcactgtccatgagcttcagcagctcaagggcgctccggaaatgctttgtgacccccttttccgtccaggatatggagccctgccatgttgcattctgcctgctgtttacccggacaatgaaggaagctttacgtccgacctggttctttacgtcctgttcatccctcattgcttccgcctcctcgccttttgccgactgtacctttctcgatttcagtgttctgtcccgggttgatgcctgaggaaaattcagcctgtcatataacgtttccatttccgttatcagctgcagctgattggaaaataaaacgggggattcagaataacagtgatacattctgcccgctacaagctcttcatttatctcatctatgcagacactgacaatgtttttgggttttggtccggcccgtaatggagtattctgcataaagcacctccctttcgctgttaatttgagtatagcgaaccacctgtaacaccaagcgttacatcagagggaattatgaattttttttaaagagtttttaattttttgatttaaccagagaaaataacagataatcagaataaaaagagcacaggcattataccctgttctttctcctgtttgatatcagccgcttccacgctttatccacaaaaaaaccgcccggatgttctccggacggttatgccttttccatatctctttatgtatatgcaattgtttcctgtcagttccaaatggaaccggcctgtctgaacgacagttcttctcccggcctgtcttcctctaccgcaggctgtaccttatactcaatagcagcacgggccttcagtccaaagctgaggaaacggctgtctattctgttctggatgacagagctgtcttccaggtgcaggccaatcagcagaatcagaaactgattggctccgtaacgggtataaaagtcccccctgcgcagtgaggagccaattgcctgcttcagcttttccatatatttttccagcttgttctcatctgttagaggctgtccctcccggtctaccatggtgcacagcattaggaaggccgcctgaccgttcctttccagcatacggcatacgatatgataacagtcagtaaagccgggataggtgcagaagtaagcgccgtatttctccttttcctcctgcagcccatccttgatatccgctaccactgccgccctgaactgaaccttatcgctcatggcatggaagcgttccatcatctcttccgacggagtcagcccaagttcttcaaaatagaaggaggtggccttttcataaacatccatggcttccttgaaacgctccatagacatcaggcagtctatctggcccagataaaattcctcatacggataaatactgcaggcccgggtactcaaatccagcagttcttcaaaccgccctctgcttttcagaagcgcctccgcttccctgagacagtcaaaatacaatttctgatattccatgccggatacggctacccattcttcccccgcaagctcaggaaggaactctccctgataaatatggcaggcttttatcagcagggcaattttctcatcctcgtccatttccttaagagccaaatcggccgtctcaagaaaaacttccgtatccaaaacaacgggctgttcctcccgatcccagaaatagcttcccgctttgattttaatacaatctgcatcaccgaagcattccttcgttttcagatatttacggagcctgtgagcattgacccggagagtcacggtcggatcctccagctcatcatgtccgtaaagccggctgatgagttcttttctgggaattccttctttgccggcagcaagcacacagatgagaagatgtatcatcttcgtagtgtttgcgtaatccagaacaacaggcgtccctccgcaggaaactgaaaaaccaccgaacatgttaatactgacaatccttttctctttcatagatcctcttcttccatgtcgcagctaaatccattcaactgtttctaagttaagtatagaaacaatattccgctttgtcaacgaaaaggatgttggtaaaaaatacagaagcatagtataatatacttaaatccggctatttcccgcactttccctctgctggaaggctccggatataacgtgtaaaatctttgcccgatcataattataaaaggagaagcttatgaaactggataccatacaccacgttgcgctgatttgttccgactatcaggcttcccggcatttttacgtggatttgctgggttttgaaattatccgggagaattaccgggaggccagaggtgattataagctggacctgaggctgggagactgtgagcttgagctttttgccatccccggcagcccggcgcgtccaagctatccggaggcctgcggtttgaggcatcttgccttccatgtttcctgcattgaggacacaataagggaattaaacgggctggggattgagacggagcctgtaaggatcgatgaatttacccgaaaaaaaatgaccttttttaaggatcctgacggcctgcccctggaactgcacgaataaccaacatattgtaaaaaagaagggctatgcaacagcccctccatgaaaaacgcactcataaattttaacggtaccataataaatttcttcctgtccctgaaaccattccaaactgccgcaggaagaacaatggtacaggtattcgcctttccggtaaagcgcagggccccggaaaggctttttttcatccacaaggcccagcgcttccttcagaaagcctgtatcgaagctgtcggccagcgtgcggccggaataattcattgaccaaatcggtactgctgccttttcctgcttttgccagaccgcttcctctccggtgaagagccgtcctcccagatacgtgtccatataaaaataatcttcttcctcataacggaaatcatgggcgcccggcctgcagggttctttttcctccccgccattcccggcataggtctgccgcttcgcccgaagcaggaaatccaccgcctgccggattcccctgtccccttccccgccggtatcggacagggaactggatccggggcagtcaatcccatatataagcgcatccaccgtaaccccaaacagtcctgccagcatcgtaaggttgagaatatccgggtaatttgccccgctttcccactttgccaccgcctgcctggtcacctggagcttctccgccagttcctcctgggacatatgccggagctttctgtatttttgtagatttgctgaaaaatgtattgtcggcatcgctgcgtcctcctgttttcttttttattgtgtctgaaagccgcttcagaacaattccattgtatcagacgcataattatgataccaccaaccaccgcctgccattctgacaacctgaggttcccttttcataaagcatggaataacgcctgcactctgtcataccagaagcctttctccgtccttacacatagctttcccggccgcctgacaacagacggccgggaagttaatgaaaatattatgcttccacaataagcagatcccagggtgcaacggtcaggatttctccctccgttaccgccttttgggaaaacagctccctgccgcttcctccgcaggcacacgccttcgcttcgccggaatagttcagatagtaggtaatccgctttcccctgccattcgttccttctctgataaccagaggggatgggatctcctgcttccaggtccaccagcccttttccttccataaagaagccaacagagccttcagatatgccggagaagtcatacagccaaaataaatccccagccccttaccgaagtccttcctggtaaccgccacatatttattccaggcataatgatcgtacccggaaaccacctgcgcatcctccgtttccagcagttccatgaacagctccgcatttctctcctcatccgcaagcgcaaaggaatctcccgccagcttcactcccgaaggcgccgtgaactggtggtacttcaccccgaagcagtccctcagaagatacggctgcacctgggtgcgcaccttcacgttttcatcggtgaaagcggttttaaaggtggctatcacacagcctccctgttcggcgaaatcccttatcctcttaaggcagtcttcctgtgcagaataaagggctggcacaaaaaggacatcgtagcgcgaaagctcttcctcctgcgtgctcacaaaatcacattcaatattcatttcatacagcgcatcataaatccatcttaccacatcattataatctgtcctgtttgcgccgtttccggggaacgggaaccatttcagggcggtcagagcttcattgctcaccataattgccactttattttcctttttcagatgcagcaggctggggctcagctcacggaactgccctccaatccggcaggcctcacggtataccgcattttcctcaaaatcatggctgagcagccccttccaataggtttcgcaggcattgtggatggaatgccagtgccagtacatcacagaatccgctccgctggcaaggtggctgaaggcctgcagacgaagctgcccttcataaggcgtccactccgggaagccctgcgcctccgtttcaatcaggaaataattgttctttttcagggatctggtcagatcgccgccaaaggcaatctcctttccggtcagcttgtcctggctgggatgatagatgtcacagcctgcaatggtcaccgcctctgccgccttaaaatgatccacatccggctgcaccccataggaatagcccttccaggcaaagtcaaaattatgggtgataaactggtccgcccttttatactccccgacaatctctgcctggcgtttcaggaaatcagtaaccagctgtctctggaacttctcaaactcacagcccaggctgccgttgatggtccccgtcacactggggaattcctcccaggaattaatccggttgctccagtaatccaggccgaaatcatggttaaaacgctccagatccccctcgtattttttccgcatataccgcacaaacatctgctgcacattctcactactcgtaccgaaatgctttgtctcattatccagctgaaaaccgatgacacaccggtaacccgccacagcctccatcagcctgcggataatccgttccgcaaaaaaacggtaggccgggtgcgtgatatccataatctgcctggcgccataaggccgcctgccgctcctgtccgtaaccatgacctccggataggccttggccatccatgccggaatcgcataggtcggggtgcccacgatcacataaagcccctcccgttcgcaggcatccagaacctttgtcacatgggaaaaatcaaacactccctcctccggctcctccgtactccaggttgactccgcgatcctgattacattaatccccgcttttttcatcatgctgatatccttatccagccgttcatagggcatatactcatcgtaatatgccgccccgtataacaattcctccataacacaaacctcctgtaaattttctgggcagttattctgcttccatcatataaagcttcctccccgactgcaagacggatatatgtggtcacctgtccacatttgggcaaatgcctttacctgctggatacggaaatggccaccagagtctatgcgccgcctgcgacgcccctgtaaaaagccttagcaatatcttaaccatcttttttatctatttacccatatacgtgttataatataaatagaaagcatacattttccacaaagaaagaggtgttaatatggcagcagcaatcattatcggctccattatagctattgtatgcggaaaataccttcttacttttattacaatttacaaaaactccgtatctccgcacaaacctggctgacaattcatctgtacgaaaaaagcagacggcgaaaaccatctgctttttactgtattcttcgtaacttttccttcttaaaattcttcttcgtcttcgcttgcagccacagccgaaacaacggaagaaaccgctgcaacaacaacagcaacaataataatcaataacataccgcccatcaaaagcaatacttccatctcccgacgtcctccatttctcctttcggccagggcccggcgttgtctttcatcggagcctgtccgcttttttcattataacataccgtaacctatcctacaagaaaaaagactccggttttcactccggagccctgcaattttctcagcgagaaattactgttatgcaattttggactttgccagctctgcaagcgtagcgaatccttctgcatcgtttactgccatttcagccagcatctttctgttcatatcgataccagccagcttcaggccgtacataaatttgctgtaagataaaccgttcattcttgctgctgcattgatacgggcaatccacagctgtctgaactgacgctttctttctttacgtcctgcgtaagaagaagtgagagctctcataacagactgttttgctactctgtactgtttggatcttgctcctctgtaacctttcgcaagttttaatactttgttatgttttcttctggcactcatgccgcctttaattcttgccatctcttaatttcctccttacgacttataaatacggtaaaatctttttcatattcttaacattggttgcatccgtaatagccggttttctaagatttctctttctctttgtggatttcttagttaagatatggctcttgtaagctttggatctttttaattttccggttccggtaactttaaaacgttttgcagctgctctgcttgtcttcattttgggcataacaaaatcctcctatactcattatcctgaaaaatctattttaactgtacgtattaacgcttttcagttaaaaacatagtcattgtacggccctccaccttgggagccttctcaactaccgccacatccgacaacatctgtgcaaaatcttccagaatatgtctgcttgcctgcatatgggccatttcacgtccgcggaaccgcagtgtcactttaaccttatttcctttggtaatgaatttcttcgccgcggtaaccttggtattcatatcattggtatcgatattgggagacatacggatctccttaatctcgattattctctgcttcttcttagcttccttctctttacgtgcaagctcgtatctgtacttgccataatccacaatcttacaaacaggcggttttgccgtaggcgcaatcttgaccaggtcaagccccgcttcctctgccattttcatagcttctttgacagacataactcctaactgggaaccgtcttccccgaccaaacgtatctccctgtctctgatctgttcgttaattaataattcgctaatagtctttccctcctaagaaacaaaggatccgcaccctccgtgcgtcctcaatctaaaaataagcaactttctccggcacagccgccggatagataaaccggaaccacccggttcaccagccttatccgccgcatctgcataacacacaaaaaaagcggatagtcagactatccacttgaattccctcaatccctgcagtttcctgccggtttcctgaacctgtaaacacctatgagcccaatcgctatagggtgagagcggatactctgcttgccagttctgtactcacgtacttgtttactttatcacatacaaactctaatgtcaacgcatttcattttattttttatattttattttccggccttattaaggaactcctccgcattatctatggtaactttataataaggaagatagatatatttcccgttctcaaactccatttcctccagccctctcccgtatacaagggaaaacgccagctttgccatagccgccgcctgtccttccttatcattatatacggtcccggccagctttgcatccataaccgccttcagccccgcgtccgtgccgtcaatcccgaaaaaaacagggatagcggattccgtaatattcagcttcgcataggcgtcaatagctcccagcgccatatcatcattatttgcaagaaccagttcaatttcattggaatgctgtccgatcatctgcatcatccggttctgggcctgcgcccggttccagttggcgatgccgtagctgagcttttccagctctatcccgttatttttcagcgtgtccaccgcattttccgtacggatgatggaatcctggtgcccaggctccccttccagcaccacatactggatcttcccgtcacggttgcggtccacccttctgtccgaatgtatcagctcagccgcaagctccccctgcatcacccccgactgtttcgcttttgcccctacataataaagcttctcccactgcatcatatcctcagcaaccggctccctgttaaaaaatatgacaggcacatcattctcccttgccagatcaatgatctcagacggatcggcgcgatccaccagattgacacacaggacattgctcccttcatcgatcagcgccttcacctgatcgttctgggtacgctgggaaccggccgcatcccggatcgtcaccgttgtttccgcaccttcctcagacagctcattcagctgttccttcaggcagtcaagcaattccccgataaacacatcgctttcattatagcatgccacgcccacataaaccttatccggcacggccgcctgcctgccgcaggctcccaaaagcagcatcgccatgagaattggcagcaatcctgcacaatatttcctaaccttcatctaatcccctcattctactggctcatcgtaaaaatgatttcctgattttctttggaaaacagcgtatccctgcgaaggacggtgtaggaaaccgtccggtcatgcattttgtagaaataatgtgtaagaatctccgccgcctccgtcaggctctgatagcccacattgaattcatcgggcaccaccaggcagcccgcaatccccgtatccagataatagaccgcctccgtggaattcccgattccatacaccaacgccccatgcagatcattcgcggcggcatattctccggccatggtaaagctgttgtcatccagggcaatcacaaaatccacagccggctgatcctccagtaacgcttccccttcttccgaaaaaggagccgcaacagaccagctgatacttgcctccgtgtttttcagggcctccaggaatcccctttttctctcaagaaccgcctgtgaatcccctgttttagagaaaatccccaggacttttccatccaggctgccgctgtaatccttcagcagctcctccgccaaagcggctcccatggcatattggttcggctctacaacaggcagccgggaatcccctccgctctcagccgccgtctgctctgtcagcagcacgggaatccggtttgccattttcctcagcatttcttcagcgcccggtacaggctgcacgatgaccgcagctgccccgttatctatttccctctctatcaggctcttttcctcttccaccgttaatgcgccgccggtgctgacaacagacatcctgacctccagatcctgctccgccattttcagtccgtattggaaggccgcccactgattgtcctcagaatcctggatgatcacagaaatccggtccagctctttcccgtttttctcccgcaccatgataaaggccacggcaatcaccatgacggtcaaaagggcttcagccataataaacatctttttgctgttcttcatctccacctgccccagagcgtattggcactctgccctacatctctttgttcatcatctcgtcccggttgaatatatgccccttctccagaatcttcctgttttcttccgtatacggaactgccggaaggcagacagagacagtggtaccctcatccggttcgctttccaccgaaataccatactcttttccaaaaaggatctgaatccggttatttacatttacaaggccgaccccggagccatgtttacggaccctgccgctgtccgtaagaaggaagcgcacctcctcctccgacatcccgattccgttatccgtcaccgacaggatgacactgccttcctgtatccgtcctgtcacccggatttccccgcagtcgtccatgccgctgactccataagctatggcattttccaggatcggctgcaaaatcagctttaccgtgcagcaggaacatacatcggggtcgatgtcaaatacaatggaaaaggaatttttataccgcaccttctggatgttcatatagctttccgcatgctgcagctcatcctttatgctgattaccgtacatccctgggaaaggctgatccggaagaattttgccagctgggaaatcatgaatacggcctcgtcattccgtccgccttccaccatccacgtaatggagtccagggtgttatacagaaagtggggattaatctggctctgcagcgcatccagctcacttttccttctttcattctgttcctggacgctcctcttcatgagcgtttctattttttcataggaactttgtatggaatgtcccaggtatctgatttccgaagagccgcctatatagatttccggctttcctcccgcctcatagcccataaccgaatcattcagcctgcatatcgggctggatatcctgaccgaaaccacccggtaaataattacaagggtcattaccatcagcagcataagcatgacgataaaataccggacattaatcatgccgtgggtaaatgtggaatcgggaatcacaccgaccagcttccagccggtatagcttatggtatttacaattaccgtcctgcgctccccttcaaaggtttcctcgcagacgccatccctgtattttgcagccgccgcgctgttttcgctcgcaatcccgtcgcttatctgaatctggcgcggatggtagataatctgcccgttgctgtcgcacagataataatactgcccgttatttaacgtattgatctgcctcatcatacgggaaatgctgaaataatccatatccacaagcaatacgcctatctgcggatccccgtgtatggtaaactccgcaacccggctcagggaaatcacccaataataacggagcgtgccgtcgtcaaacaggttctggatatgaggcgtggaaaaatgcatgttttccattttctccatggcctgtatataccagccctgcctggtgacgttgggatcctccttctggctggcaaccggctccgccgcaatcaggctcccactgccgttgtacacggcaatgctgcgcagattccccttgttggcctcgtataaaagatccattccctgctgaatcacatcgctctgatcggaaaagtcattctcttttatgacattataatagaccgcatccgaaatctgccgcatgctgaccaggtaatcctccagattttcccctgcctgctccatcagcttttccgtactctgtatcgttttcccccgggacagggtagaaaacctgaagtacatcacaattcccagaatcagcataattgaaatggatattacggaaaacaccagcataattgtggattgaatccctctggacttattttttttcatacgccggaaatatttatttctcacatgagccatgctccattctgtactttgaaggggatacgccgaacctccgtttaaacacatagctgaaataattgggatcggtataacctacgttctttgcaatgatatagcttttttcatttgtttcaatcagcatccttgacgcccgatccatccggtattccgtcagatagccaataaaggagtttcccgtctccttcttaaaaacagtggaaaaataggaattggacacgcccagaatctcgcagatattatccagtgaaaattcttcatccgaataatggctgcccacatattcctttgccttaaatacaaaggactgggttgatttgctccgcgcgctgattaaagtttcccgaaacaaaagacagatgccgataagccatgccagcagcgcctccggttccaaatccagaagccgcaggtacagattcctgatattcccggcaaaatccgggacatcaatatcattattcaccgcaaatctgtacagggcgcttatcagatccatcagggcgatatgatactgctgcagggattgggccggacaggatatatgcttcatatagcgcttgaccgctcccacgatatcctccttggaattcaggcggatcatgccgaacaggctaaacagctccgtatcaggcgtgccgtccggtttgcttatttcgtgaggcgcaatctccttcatattgatggccctggaaacgccgtagataacccggtaagaaacagcttccctcgcgctgctgtaggactgggataaaccggtgagccgctcacagacctgtccgatccccacagtgacaaccgcgccgatgatacgccgtgcatatctgcagaacctgtcgcattcatccgtcagctccggcacttcatttttactctgaagctgcgcaattaaaactgtgttttccagataggaaaagcattttgcctgccatttttctcccagatgctccctggcctgcttctggacggacgcggccagcagcagcggattcatgttctccggcacctggctggaggatgtgtgcaccacaagacagcagtaaaaaggtccctcaaaggaaatctgataattggacagatatctggggatttcctcctcgcgcagcctgccctcaatcagcgtggaatagaagtttgcctgcaggaacggaagcgaatccatatagtacttctgcaggaccgccgcgttgcgcttttcactgatttcctgatccagctttattttcagctgggtgaaaacattgatgagctccgtagagtttacaggcttgagaatatattcctccacctccagatggacggcctcttttgcatattcaaactcatcaaagcctgtgaggaaaaggattttggtggtggtaaactccgccttaatacgttttgccagctccatgccgtccatataaggcattttgatatccgtcaaaaccacatccggctgaaactcctccaccatttccagcgccttgacaccattgttggcaaatccgatgacggagaagcccagtccctcccaattaattttccttctgatggccttgatgacctcttcctcatcgtccgccagaagcaccgtatatgtatccatatttattctccatatgcatgtatccgggcgccgcatttttccttactatgattataacaaatgccaaaaggtatgtaaatgcgggagccatgcacaaaagagccagaactgcttccggctctctttgcaatatcaggcactattttttctgtacatacttcaggcagtcaagggtgactgcagtaatgatgatgatcccttcaaatacgaactgaaggtttgtatcaattccaaggatggtaagggagtaaataagcactgtaaaaataagcacgccgactaccacgcccgaaatcttgccgatgccgccggtaaaggatacgccgccgaccacgcaggccgcgatggcatccatttcccagccctggccataggccgccgagccggaacccaccattcttgcacattcaagccatgagccgaagccgtaaaggataccggccaggatgaatgcccccatagtcacgccgaacaccgaaatgccggaaactgccgccgcttccggattcccgcccactgcatacagatttttgccgaaggtggttttattccagataaaccatacgatggcaatggccgccaccgcccataaaataattgtggggaagccattgagcctgggaatgatcaccttgggaatggaaggttcgatggcgccgaaggacacgccctttgtggcatatgtaacaaggccgaaaatcacaagcatatttgacatcgtggaaataaaaggatgcattttgaatttggcggtaaagaagccgccgatggctgtaaaaaatgtgcaaagaagaatacacattatcagcgcaaaaatcactctcaggcccaggggaacgcccgtaaagtcaaatacatggccgaataccgcgcctgtgttgattccctgatgcatgatgatggttgccgtcgtcatccccatgccaaccatacgtccgatggaaagatccgtcccggtcagcaggatcaggccggcaacgcccagggcaaggaacattctgggagaagcctgctggagaatgttcaaaacattgttataagtaagcaggggaacatgctttacaaagggtgtaactatgcacagtccgataaaaatcaggataatcgcgatatacaggccattctgcagcaggaatgtccttcggttaaaggtatatttgtaattctcccatttctgcgcccgcatctgcataaaagtaaatttagacattcgcagcatatcgatcagatgatatttccagacaattgccgcatgcctcctgtccttgatctgcgcaagctctttttccagctccattttagcatcgaatcggagatttttataaacatacttttcgttttttatttccttatgatcggtaagctttgccagggtttttttatgctcctgctcaagctttgcaatattatcggcatattttttctgcgcggccacatattcctgtgagcagctttctttcaccgcctgataatagtccttgttaaaatgggccttcagatacccttccgcatcggcaattaacttggagatttcttccttattctttgcttccaccgcttttgcttttaacatctcagacttgatttcttcagtctgtgctgttttttcttccttcgtaaggccatgatctctctttattgcgtcaatttcactctgaagggaaaccaccctgtttgatccatccactctgagactgtcaatcttttcctggatttcacccacataatcctcaattggcttacgcagctgcatttcctgttccgccgtaagggttttattattttcattatccatatcacaatctcccctttataggtattttgcactgagtctcaacagctcttcctggtttgtctcttttgtattcacaattcctgaaagacgtccgttcgacataacgccgatacggttggtgattcccaatatctccggcatttcagaagaaacaacaataattgtctttccctgcttcgccatattgatgatcagctcgtatatttcgtatttcgcacccacatcgattcctcttgtaggttcatccatcatgaacactttgggttcccgctccagccatttcccaaagataaccttctgctggttgccgccggaaaggctggagatcatgtcatccggccccatacatttggtatgcatgattctgatttcatttccggtggcctttatcatcttcgcattggaaagagccacgccgcttttatattgttccaggtttgcaatcgtggtattaaaggtcagatcccccttcaggaaaagcccgttggcctttcgttcctcggtaatcatggcaaacccatgctccatggcctcttttgcgctgctgaaattcataaggcggttattgaaatatacccggcccgccgccctggtgcggaccccgaaaatcgtttccagcagctccgtacgccctgcgcccaccagcccgtacaggccgaaaatctctccttcccttacgtcaaaggaaacatcctgcagatgcggttcgaatttagtggacaggttccggatggataaaaccacccctttggggacattgtccaccggcggaaaacgattatcaagcgaacggcctaccatggccgcaatcagctcgttcatattggcatcgctggttttcttcgtcataaccaggttgccgtcacgcagtaccgatatctcgtcacagatttcaaaaacctcatccattttatgagaaatataaatcagcgcgatcccctgtttttttaacatcctcatcatcccgaaaagcttatcgacttcctgcacagtcagtgaggatgtaggctcgtcaagaacaatcactctggaattataggaaatagccttggcaatttcacacatctgacgctgcgacacggacatattccgcatgggctgcgtaagatttacggtcatacccagcttccggaaaagatcggaagcctcttttttcattctgccttcatcaattacacccatggaattcaccggataacgtccgagaaacagattatcaaccacattccgttccaggcactggttcagttcctgatgaaccatggcaatcccgttctcaagcgcatccttgggaccggaaaagctcacttccttcccattcaggaaaatggtcccctcatccttctggtaggtaccgaacaggcacttcatcatggttgactttccggcaccgttctcacccataaggcccatgacggtcccgctccttacatccaggctgatgcggtccagaaccctgttccggccgaaggacttgctcataccgcgtattgataagacgatatcatctttcttatctgccatattttttactcctctgctataacttcccaaaagaggttattagggagaatttcttctccctaataacctgcctgcacggctttcatttccatgagttttactgatcgagcaggcttgtataagacgccgcgttgtctgttttaaccatattgatggcaaatgcatcatactggctgggattgcccagacggttggtaatattggattctgtctgtccgtcaccgccgatgtaatcaacatccaggttgaggagcttatcatacttctgaagaagcggctgataggtggatccaaggaagttatcggaagaattataaatattcagccataccttctttacagggcttgtagcctcatccagctgattggataccggcgcataaaccatggtggaatccatataatccttataattgtcagcagtaacagccacgttcaatgcataataggaacgctcatcttccctgtatacatatacgtcatcactgagcacatttcccgccgcatccgctgtggcgatgcctgtgttaatatccactccgtcaagcgcattacgcaggacacgaagcgtcagataagcctgaacatccgcatgctggctgatggttccgccgtagccctctgcgatagcggccactgcgtcgctgtttgcatcataaccaaaggtaggaaccttgttgtctttagaccaggcgttaaacattgacatgcccattccgtcattattggaaacaacgatatcaatctgatcgccgaaggaagaagaccaggtgccgatgccgttgccggctgttgccgcatcccatgtcgctcctgcggaattcttcatttcctgggaagccagttcgcggacaacgtaagtcttgccgttcacttccagggttccatcctgtacggccgacgctgtgccgtctgtattggttcccaccggttcgctgttgatgttgccgtctttgtcaacagctgtgccaagagccttgcggacgcctcttgtacgtgcgatggagtcattatgtccgatatcgccgatggccagcacatagccgatggttccgtcgccgttacggtcaatagtatcaatgttcttttcgatataatcttttaccatggtaccctgaagctccgcaccctggttggcgtcaaagcctacataataagtatctttgttgtaattcaacgctgtcatgtcaagctggcctgtggcgctgctggaaggctggcggttaaaccataccagcggcttgtccttgttcgccatcgtccctgtgtcggccggcgccgcttctgccggcgttgttgccgcagcagctgtcgtttcctttcctgcagccggtgtatcagccgccgcaggtgttttgctggcaccgcatgcggccaaagacagccccatcagtattgccattgtcatgcaccccaattttctcttcatatttttctcccttctgtttgacacgcttctttgtatttgtcaatatggatagtttatatgatatttatccagtattatatagaatatttttcgattatcattgaaatttctatttttattcaacgcatatgctgcaaatataacatttttattcattttttataagcattatctataatgtaacagttctgattaaagcaacaaaaaaagcgggaaaacgcacaatgatacgttttcccgcttctgcttttatatcctgcaaaaacctgtaaaaataaatgctgccgcctcaggcggcattaatcagatccctccatgtaagcgcagggataatatcagttacagcttatctttccttaaaggtagcacaggctgtctcaccgcagtcacaggcgccgcagcccttgatgtctacatgctccgcatagcacttgtaatttgtgttatacacacattttacagcttcgcagtcgatgctgatagtcctgcagggattcatggcgttggatgcggactcaccggtcctgtccttgaagctttcgcagcaggtatcgttttccttctgcgcttccttgcctcctaccataatatcgcccttgcagcagcacttgtcattattataggtacaattttctactacacatttcaattctgccatttttggttgcctcctgaaaaatcatatcaaaataaacctgttttatggtttcagaattattttgtctttttttcaggaatttattcatggctgccggcccagacggtatatattgaaccagtagcgttccagcaggcagctgtccgcagtctccacggacttaattccccgtttctgccattccttaaggattccgtccctggcaaggccgctgccgatgaaccacacagtttttccgctctccagctgctgatctatccattcctccccgggcacggcatatactcccgggaacatctcccttatcagcgtttccggcgttcctccgtacagatagctttcccttggaagataccagccggttacggcctgcacctggtcaaaattaaacaggacgatatcctccgcccctattttggccagctcctcttcggttctcgtcatctgttcttttttcatcacctctccctgcacaaaggcggaataatcagccgcccccacaaagagaagcaccagcagcgaaggcaccagcaccagagccttcttctgcctgctcaggaaataggaaaaacagaaccagaagcagcccgccgcaggaagcatatagcggtaaatgaaaaccggcctcatcaggaaagacaccgcaattccgaaaagcgcagtccccgccagcacgcagagtcccaaaaaagcatatccgtcccgtcccggatttcgttccctgtccttacgctttaaaaacgcatggataaggaaagccgccagcaaagcaaaaaggaccaccgccaggccgtaatccaaaagctgatacccggtggagggcttcagcatgaattttacgcagccgccgaagcagcttaaggtcagcggaagaatccagtagctttcccgcacctgggacacctgggaaacggccgcgggcagccagggcagatatgccagtacggagattcccgcacagaacagccataccagcagatacttcacccgttcttccttcttcttaacggacaaaagcacagccacgcccacatacagcgccgccgccgcaaccgccgcaaaataatgggtataggccgctgcgatcccataaacagtgaaggcggcccaatgccttttcccgcctccctccagaagctctcccgcatgcaggaatgccgccgtaataaaaaacagggcaaagccgtacatcctgatttccgtcgtatagttagccatctgcggcatcgccaggatgcagaaggaaaaaagccctgaacaaagccaaccgtatttcttccttataagagtcagggaataccccagcagcgccagataaggcagcacggaaaccaccttgcagataattacggcatccgcccccggcgcaaataaatgcaccagctccacagcagcctttaccatcagataataaagcggtgggtgaacgtccctggccgcaagcgaaatcatccgccccaccggctgggaaacgaagcccaccgtaaaaagctcatcataccagatatcgctgctgaagcacaaaaacaaactgcagcaggccattcccagggcgcacacagacagcaggatacctgctgtctgccgccatgtctttttttcattactcatctatccgtctccgtcataccagggaccagccgggaaaaaaccgccgcagatgcgccgtgcggatttttcccggctgtaaaatcactgccgatgccaaaaaggatggcttattttgcaggctttccgtcctctgtcaccgttattttacggatttccttcgtcctgatttccctgcagatatcattgataaaggtatccagaggcttcacgccctcatcgccggcaaaacggcttcttacggaaaccgtgccgtcttcctcttccttctgtcccaccacaagcatataaggcagcttgtccagtctcgcctggcggatcttataaccgattttctcggaacggctgtccaccgtgcttaaaataccgttatccttcagcgtcgcgttcaccttctgcgcatattcctcatatttttcagaaataggaagcacacgcacctgttccgggcacagccaggtggggaacttgccttcgtatttttcaatcagccaggccagcgttctttcatagcagcccatggaggttctgtgaatgatataaggacgcttcttctccccgttggcatcaatataagtcatatcaaaacgctctgccaggaacatatccagctggatggtgatcatggtatcttccttgccatacacgttctttgcctggatatccagcttcggtccgtagaaggccgcttcgccgtcttcttccgtaaactcaatgccgatatgatggagaatatcacgcatcatattttgcacataatcccaggtttcctcgtcgcccagatatttatccttattattgggatcccacttggaaagacgataggtcacatcctcctccaggcccagcgtggtcaggcagtattttgccagatccacacagccgcggaactcttcctcaatctgatccggccttacgatcagatggccctcggaaatggtgaactgacgcacacgggtaagcccgtgcatctctcctgaatcctcattcctgaacaatgtggaagtctctccgtagcggcagggcagatcacggtaggatttctggctctgcttgtatacataatactggaaaggacaggtcatggggcggagggcgaatacttcatcctccttttcctcatctcccagcacaaacatgccttccttataatgattccagtggtcggaaataatatacagatccttttttgccatcagaggagtcttggtcctcatatagcctctcttctcctcttcatcctcgatccaacgctgcagcgtctgaatcatcttggcccccttgggcatcagaagcggaagtccctgtccgataacgtcaaccgttgcgaacagctccatatcccgtcccagcttattatggtcacggttcttgatattatccagatattccagatactcggccagctcctccttggtattgaaggctgttccgtaaattctctgaagcatggttctgttggaatcccctctccagtaagcgcctgaagaagaggtcagcttaaaggccttgatccccttggtgctcatcagatgcggccctgcgcacagatccgtgaaatccccctgcttataaaaggaaatctccgcatcctcaggaagatcctggatcagctccaccttataaggctcgcccttctcttccataaaagcaatggcttcctgtctgggaagggtgaaacgctccagcttctcaccctgcttgatgattttcttcatctcagcttccagcttatccagatcctccctggaaaaaggctcgtgctcaaaatcataataaaagccggtatcaatacttggcccgatagcaagcttggcttcagggaacacatgcttcatcgcctgagcaagcacatgggaagccgtatggcggaccacagtcagcccttccttatcccttgccgtcaggatcgccagctcgcaatccccgtcaagcaccgtgcgcagatcctccaccttcccgttcaccagccccgcgcaggccgcccttgccagaccctcgctgatatcagccgcaatctcaataatacttttgctctccgcatattcctttacggaaccgtcttttaatgtgattttcatttttacgcattttctcctttgttctctttctcatcctccccggtaatcacatcattaccggcaataatcaggcccctcttaatcggcgcccagataaaacctatgataacccctgccatcagaaaaaccgccaaaagcagagacatctctgttttcgtcagccctgaaggctccttcatcagcttcttcacagaatccgcgccctcacgcaccgactccttcacctcagccagattcagatactcagaaatcccgctcaaattactcatacaaaatctcctttcctacacagccggccccgcacccgcgctttcccgcgccggcactgtccgccggcaactccaccggcaccccgctggcaactccgccaacaaaaacagaaccgcctcccggcggcccctctccaatcccaagaccggacgctcctgcaacgaaaaaacaaaaccaatacctagctgtattgtatgctacttcccctcggatgtaaagtactttttccccaccatgcaactgttcaccccgtgaccagtaacctcacatttaccgccctattccatccccctccaatgccctcaagtccttaatgcccttattaagtccttaacgcccttattgccctttctccctcactacactgccagggaagccggagaggcggacaggggtttggggggcggaggtttttgcgggagggagagggacgggcggatgccttttttcagcttccgttttcagtccatggagatgagacttaaaattatggaaggcacacctgacataatttttgcccaaggctcatcgcaatgcccggactgaccggaagcagaaaaaaggcatccgcccgcccctctccctcccgcaaaaacctccgcccccccccaaaacccctgtccgcctctccggcttcccgtcccccccttcatgaaaagactctaaaatttatgaaataatgctatctttggttgacttccgcaaaatccggtatatataattactgttataaggataagagtaactaaaaagaaccggaacaagttactgaataaaaaggagcgcaaaattatgcaagaagccaaatcaccaaagaaaccactactctactattactgtattgccatgcttgtccttctggtcctgaacgcctttctttttcccaggctcatgtctgcccaggtagaagaggtcggctacaacacctttcttgaaatgatggaaaagaaagaaatcgcccaggtacagattgaaagcaaccaaattgtatttgcggacaaaaattcacccaccggtttttataaaacaggccctatggaagatccttcccttgtggaccggctttatgcatccggagccaccttcggcacggaaattgtaaaacagcagtccttcctcgtcaccttcctgctgacctgggttctgcccctcgttgtaatgatagccatcggccagttcctgatgcgcaaaatcatgaacagcggaggcggtgtcaattccatggccttcggaaaaagcaacgccaaggtatacgtccagtccgaaacaggcatcaaattcgcggacgtggccggcgaggacgaagccaaagaggtgctctccgaactggtagactacctccatgatcctaaaaaatatcaggaaatcggcgcatccatgcccaaaggcgccctccttgtaggccctcccggaaccggaaaaaccctgctcgccaaggcggtggccggcgaagccaacgttcccttcttctccatttcaggctctgaattcgtggaaatgttcgtaggcgccggcgcggccaaggtcagggacctgttcaaacaggccaatgaaaaagccccctgtatcgtcttcatcgatgaaattgataccatcggcaaaaaacgtgacggcggcggcttttcaggaaatgacgaacgggaacagacactgaaccagctccttacagaaatggacggcttctccagcaacaacggcgttctcatcctggccgccaccaaccgtcccgaatccctggatcccgcgctcctgcgccccggccgtttcgacaggcgtgtgccggtggagcttcccgatttgaacggcaggattgccatactgaaggttcacgcccagaaagtaaagctgggtgacaatgtagattttgccgccatcgccagaatagccgcaggcgcctccggcgccgagctggccaacatggtcaacgaagccgccctgagcgcagtccgcgcaggccgccgattcgtcacccagactgatttggaagaaagcgtggaagtagtcattgccggttaccagaaaaaagaccgcatcttaagcgaccgggaaaaaatgatcgtttcctatcacgaaatcggccacgccctcgttgctgccagacagaccaactccgcccctgtcaccaaaatcaccattatccccagaacctccggcgcgctgggctacaccatgcaggtggatcagggcgaacacaacctgctgagcaaggaagaactggaaaataaaatcgccaccttctgcggtggccgcgctgcggaagaaatcatcttcaacagcatcaccaccggagcctccaacgacatcgaacaggccaccaagctggcccgcgcctgcatcacccgctacggcatgtccgaggacttcgacatggtagccctggaaaccgtcaccaaccaatacctgggcggcgacacctccctggcctgctccgaacataccgcagcggaaatcgacaggctcgtcgtagccatggtcaaaaaagaacacgccaaggcctgcgacatcctccgcagcaatataggcaaactccatgaactggctaagttcctctacgaaaaagaaaccatcacgggggatgaattcatggctatcctggatggggatgtgtaaggaataattttgtttgttggcagccctcccagccccgcagcgtcagctaaccgggccgtgtcctggctcccgggatgagaaggctctggcgggggatggggagggtatttttcatttaccagtcagaccgggcattgcgatgagccttgggcgaaaaattatgtcaggtgagccttccataatttttaagtctcatctccatggtctgaaaaggtaaatgaaaaataccctccccatcccccgccagagccttctcatcccgggagccaggacacggcccggttagctgacgctgcggggctgggtgtattgtaacaaatataattatttttatatatccaggatatgcaatgaagacagaacagcttattggttgctgcaaattatttttagtttttatgaagggctatgccgtcattaggaagggtaactggcctcgaaaatttttgcggctattcatttacagttatacgcagcgaaaggggattctgagttcgcctttccggttgtaatagagaaaggggtaagctggcctttcaagcttttgttattgctcatccacagtcgtatgcagcgataggggaacctgagcgtggctttccggcttaggcagagggggaggggctgtggttttggcccttgggcagcatggagtgcggctggggaggcggggccgggcaggggatttttcatttaccttttcagaccatggagatgagacttaaaaattatggaaggctttcctgacataatttttcgcccaaggctcatcgcaatgcccggtctgactggtaaatgaaaaatcccctgcccggccccgcctccccaaccgcactccatgctgcccaagggccaaaaccacagcccctccccctgcctaaagccggaaagccacgctcagattccccgtccgccccactacctacccaggatagtgttgcggtattcgttggcggagattcctgcctgtttcttgaataccctggaaaaatgggccatatccagaaagcccacttcttccgcaatatcaccgatgcgcagtgatgggtccttgagcagttcttttgctttttcgattctgatgttattgagtatttcggagaaattctggcccgtatgtttgttcagcagtttgctcaggtgccactggctgacatatatctgatcagctacatcggagagcttcagtttttctctgtaattttcttctatgtaggctaatgcattttttacgataaagcagcttgcagggctgtctgtctccccggcttccctgtcttccccggcggcgtctttatcggacggttcattgccgggagcggtttgggcggcgccttttgaagcaatatcttttattgcagagtatcccggtgcattttctgcgctctgtcctgtggggccttttccggcggtgtttcctgtgcttcctgtatttccgccgccttcagtgtctccagcgtttccggtctttccagtgtttacgccgttttctgattctccgtctgtacccatgattccctggcgctgcaggttctctatcatgacgcggatcgcttcgtccagttcatccattttggagggcttgagcaggaatcttgttacgcccaggcggatagcctgctgggcatagtcaaaatcgcggaagcctgtgaggatggttatctgcataggtccgaactccgatttcatgcctgcaatcatcgtcaggccgtcaatcccgggcatacagatatcggaaatgaggatatccggcctcttttcccggatcagcttcatcccttcctgtccgtcgccggcggtccccaccacccggcagttgtacttttcccattgaatcgtcattgtaagtccccttacaataacgggttcatcatccacaatcgccaccttgtacatacgaattatccccctgtgtcatgtactttcagtatttcagttacaatgctgccgaaggctgaactgctaaaacagtttcaacattttttcattataacatatacggccaaaaacggaaagtgtcctgccgacagacactttccgtttttttattattttgctgtaattcgggcaaccgaactgtttcatttttgtttttccggaatccctccgggaaaggcgaagcaaaagcttctgcgcattatcccttaatggctcctgcggtcatacccttgatgatgtatttctgcaggcatacataaacgataatcagcggaacaacaatcagggaaaccgcggctgccatcaggccgtaatccgtaccctgtctgccggaaatttcattcagcagtctggtaattgcccagtgcgcagggaaacgcaggaagaaggtctgggtaaacaggtcgttgtagctccaaaggaagctgaaaatgccaaccgtggcaaaggagggctttgtcagcggcataataaccttgaagaaaatctggtaagcgttgcagccttccatgtaggccgcttcttccagctccaccggaagccccttaatgtagccggaaagcaccacgatggcaaaggccaggtttcctgctatctgcggcagcgcgcaggataacagcgcaagccagaggttgttggtgttaacgatgtgccagctggattccatacggaatacgggaataatcgttgcaaatacggggaacatcattgctgcgataaccaggctgttcatcagtccgctgcctttgaatttatagcggaccagcgcataggaggcaagccctgcaaacaggataaccactgcggccaccgtacaggaaatcagcaggctgtttctgtaagcggtaaaaatactgaatttattgattgccttctcataattatccagtgtgaacagcgcgcccacaggaaatgaaaaggagttggatactatctgttttttatccttgaaggagttcatgacaacccaaatcagcggataaattgtggtcagcgcccagataaccaggaccagatatacaaacagcagccctacggaaaatttcttctttttcattttgtataccccttcctaataatctttttctttgaaaatcatgttgacaaccttggaaagcaggatgccgagcactacgataacgattgcaaccgtacagctgtagtcaatgtccttgccctggaaagcccagtagtacatgtatgtaccggtcagccaggtctcgcccatcggcatgccgttgggcagcatcgtccagggcaggtcgaaaaccttcagcgcacccgttacagccaggacgctgcaggtgcagataacattgtggagcaggggaagggaaatgtaccttactctctgccatgcagtggctccgtcgattgacgcagactcatacagctcatctgaaatattgttaaggcccgtcagcagaatgataaaatagaagcctacatactgccacataaccggaaccatcatagtcaccatcgcgtgggccgaatccttccagtccgtaagctccgttactccgaacattcccaggaactgattcagcatacctttgtcatacaggaaaatcaggttgaacagaaggccgagtgcggtagcagataccacaatggggaaaaagtaaacgattcggaaaaattttgctcccctcttgatattgtctaccatcagggaaagaatcaatgcgatccctacctggccgagcaatgttaccactatcatgataagtgtgttcttcatggcaattgccatatttttatcggtaaaaagctttgcataattcttgtaaatcgggtcattccagcccttggcgggcgcccccaaatccttaattatctggaagctgtttatgatgttcttaaaaaaaggataaaacagatacagcgccaggaaaaggaaagccgggaaaaggaagaaaaagacaggttttttatttttataaatatttggttgattgttcataccaacacctctctgcccgtttcatcgggcgctgatattctaaaatcagactggctttttaaaatattgctttcacggttctttatttacggcatatcatcattattttctttatgaaagggccggaggaaatgccttcggcccttgtgctgttatacaccggtcctgtatgataacaggtccgcataattactcgttcatgttctcaattacctgagagattgcgtcctcgatagctacgctgccggttacgatttcaggcatatggtcaaagataggtgctctctgttcctgtgtgcaaaggtcctgagctgcgccggtaacaccggttgctgccttaaccatatcaaggctgtcaatctgcagggaattcagggaagcggtatccagtgtaacaccattcttcagagctgtagctgctgtctgagcgaacagggatacattttcatcggttgtcatatcgctgatgaaggaaactgctgctgcgcgcttatccggatcgtcccatgcttttttggtaatataccagcctgaagaaagtccgctgatgatatctgtagccttacgctcgttagcgccggggataaatgtaacagtaaagttatcaatatcttcggtagcttctgcaataccgcccattttccaggaaccgtctacatagaatgcggacttgccgtcgataaagctctggaatacttcagaagcttctgcggtattggtattttcagagaaatagcctttttcaaatacgtccttgatatctgccagtcctgctgcccatgcttttcctgctgcatcatccagagctgccggaacggatgcatgtgtggccggtgtgtcatggttgtatactgcaaactcgaaccagtaatgaggctcttttgccagagaagctgcgataggtgtgaagcctgcatctttaatcttctggcagatttccatgaattcttcccatgtggtgtctgcaccggggatttctgcgccagcctgctcacaaacagatttgtttacgaacatgccttcccagtatccgtaaaaaggaactgcgtatttcttattgtctgcaggacatgcaggaatcatttcgtccttcatgttggatgcataatccggatatacggaacggatttcatcaatggttacaaccttgccagcctctacaaacgggttggagtcgtttccgttgaagtagaacagtacatcgggttctgcgcctgcttcgaagtctgagataacacgggacttaaaggtttcatctgcgcttcctgaggaatctgccacgctgcagccgtatttgtcttcccatctcttaaccgcatcctgatagttctggacgttgctttcctcgcctgcaaaggttgttgttacattcagggtgattccgctctttacttccagggcgcctgcctctgctgcttctgttgttgtttcttctgccgccgctgtgctctcagccgcctgggactgctccgctgctgttgtttcagcaggtttggattctgttgctgtctggcttgcgcttccgccgcagcctgccagtgaagctaccatcgtgcatgccaatacacaagctaataattttcttttcatgtaagaaacctccctttcgttttggatgacttgtttttcatctgtacttatcatataacaatcaagcggaaaggttaatgattcctattgtgattatttgtcttttattgttctgttgcgccaaaaatcatttatgcaatttgactgttattgtgctgactgtttgatcctctttgtagtttttgattgtcagaccgcagtccgggccatatattatctttaatctcttgttcacattgcgtatgccaaggctgacggagtgctgttcggccatatccggggaatcgctcagcagcgcttccaccttccttttgtcctcctgggtcataaggccgtcgtttatgacttcaattttcagcttgtcttcttccgcataaatacggagcagaatcttccccgccctgcctgccaggccgtgttccaccgcattttccataatcggctggatgatcagccggggaacctcaatgcgcatcagcgtctgatctatccgcttctcatactggaatttctcgccgaagcgctgtctgatgatatagcagtaagcctccacatagctgatttcctcagaaagagggatcatctgctgcttcttcctgtccatggtggcctccatcatggtggaaagggcctcaatcatgctgctcaccctttcattcccttccattctggcctcccagttgatgatttccagcgtgttgttcaggaaatgagggttgatttgggactgcagggccatgatattggcatcccgcaacgccagctcctccaggtaaatctgttcaaactggttcttcagcttatccgacatgctgttgaacgcgttattcagataaaggaattccctgcttctctcctccttttcgatcttcacgccgaaatggcccttttcaatttcagatgccgcatctatcaggccctgtactggcactgtaacattcctgtacaggaaataaaatacaataaaaataagcggtatggtaaaggccatcatcaggatagtaatatacctgagcgccattttttcataatgaatggtgtcataatcaagcttcgccacataccggatgacatgattatccattttccgctcacagattacatatgcgttgctgcgcccttcatgatacaggctgcttcttcctgcgctttccctggcagcgtaatcctccgcccagtcccttccccagatccactgtccatctatgctcacatcgtaatccacaaaccagggaatcccctcgatgctctggaatacgctgtctttgtcaacatccataacaataaccgcatacggctcataggcgggcgtcatgatattccggatcatatacagatgatccttctgcgtcgcacagcctataccggtatctatttcctccgctacctgagccacgatatcacgtgcctcattctcaaactccttgatgctgccatagtaattactcctgtaggtaaaatacacatcctcaggcttatcaataaaataaacgattgtacttaaaaagctgctgtcataacgatacatctgctccagaaagttggtcaccttttcaaaaagcttcacttcattatgatcctcctgataccgcttccagctgtccttgatatccggcatataggaagcgcttctggataccctgaccgccgaggccacccgcatttcacatatttccaccgccgtatccatggatttttcgatattatcctgcatctggacggagaaccggttagacacataatacaggatggccatagttaaaatggccagcggcagaagccagcacatcagcatcagaatggtcatgctccatttcagctgcgcgggctgcctcttgtttcccgaaaggcggtgtggtttccatatctgtttcattgtctccccctcatggtagtatgaagaaaggagccagtaaactaccggctcctttctgaacactatcgttcctgtaaactctcactccattttcgtctgccccggaggcattgccggcgtacaggccctgccgccctgcggcagcaggttcctgtgcttcgtcagcttttaacgatgcatggagaaggaatccatatcataatttttcagattctcatgaacgcctctggcgtctgcctgtgaaatcagcttatccctgtcctttttggcagtcatcgccgctttatggcggctgggtcctccgacacagcctccttcacagatcatgccttcaatgaagtcctcaggcagcttgcccagcttgaacagcatcagcgccttcttgcattccgcaatgccgctgcaccttgccaccttgatatccgtgctctcgccgctttccttcaggcattccacaacagcttccgtaacgccgccgccattaccgaaacgctttccgaatacgcttgcttcctggctggtattctcttcgggctccagttcaacgccctttgcacgcatcatggcgcggatctcaccgaaggtaagtacgaagtccgcatttccttcaatgctcttgtcctgcgcttcagatttcttggcaatgcagggcccgataaatacggtaacggtttccggatcctttgctttcagcattctggatactgcgcacatcggggaaacggtagtggaaatgtttccaaccagttccgggaaatgctttttaatataatttacaaatgcaggacagcaggaggtagtcattttcttaccttccttaaagctctccgcccattcctctgcctcaaatgcagcggtcatatcgccgcccaggcctacttcaacaaaatcggcaaatcccagcttcttcatcgctgttctccagcttgccatggtgatgttctcaccgaactggccttcgccggcaggtgccagcatggcaactacctttttgccttcacggattgcgttaattatgtctacgatactggtcttggaagcaatcgctccgaaaggacaattatggatacactgcccgcactggatacacttggattcgtcgatctggcatacgccgtgctcatccatggtgattgcactgacagggcagctcttcatacagggcctctggattttaacgatagcagaataggaacatgcctgcgcacatttaccgcagctcttacatttttcgggatcgatgtaggaacgatcattaccaatggtaatcgcgccgaaattgcatgactgcttacaggattttgcaagacagccctggcagaggtcggttaccacatagccggaggagatgggacattcctcacaggctgagttgataacctgtacaatgttgctgctttctctgttgccggggcacttgccctcggccagccttactctctgacggatgatttcacgttccttgtaaatacagcagcggaaatgcgcctcgggaccgggaatcatttcatagggaatattctcttttttttcatccagctcaccggcaaaggccagtttggcaacttccgtgagcacctcgtgcttaatctttaagatggtagcgtcatcagatactatacccatacttttgtgtttatcctctttcctgattgttaaaaaattaactggtacatttaaaaacaaagctggatttgagacaaatcccaagccagcttatatttttagcaaaaagtaaagttgtacggcgccttaccggggtggccgggagccctgcggctcccgccccgtccggcgtaatatacctttcacagaggtatattgattagttatctccgtacagaacctgcagcttctgcagataatcatatctttccttagcgttttcagcagcctgagcctgcagtcttgcagccttttcagcatccttcagcgccagggaggtgtatcttacttcaccgccgatgaattcctggaattccttggtcggagccttgctgtcaacaacgaatttcttctctgcagcagggttgaaacggaacagattccagtagccggtctctacagccagcttctcttctgtctgagccttgctcatgcccttcttgataccatggttgatacaaggagcgtaagcgatgatcagggaaggtcccggataagcttctgcttcagcaatagccttaacagtctggttgtaatcagcacccatggaaatctgtgctacatatacataaccatagctcattgcaatgcttgccaggtctttctgcttcacttctttaccgccggctgcgaactgtgcaacagcgccggtaggtgtagccttggaagcctgtccgcctgtattggaataaacttcggtattgaataccattacattgatatcttttccgctggcgaggatatggtcaacaccgccgaatccgatatcatatgcccatccgtcaccgccgaatacccactgggatttcttggagaggaagtctttgttcttaacgatatcctggcatacgccgcagtctttgccttccagagccgctaccagcttgtcggttgcaggtccgttggtaacgccacagttgtaggtatccaggtattcctggcaaacagccttaacagcttcgtcatcggtattggcaagaacgtcttcaaccttagccttcagtccgcctctgatagcgttctgggcaagcagcatacccataccaaactcagcattgtcttcaaacagggagttgtcccaagcgggtcccttgccttctttgtttacggtataaggtgtgctcggtgaggagttaccccagatagaagaacatcctgtagcgttggcaatatacattctgtcgccgaacagctgtgtaatcagtttagcgtaaggtgtctcgccgcatcctgcgcaggctccggagaactcaagcagaggctgtttgaactgagatcccttaacggttgtttctttgaatttctcaagtacttcgggcttctcggaaacggtctgtccatagttgaagatttcctgctgtgccagctgggtttcaagaggagacatgctcagagccttctcgcctctcataccaggacatacgttagcgcaggaaccacatcctgtacagtcaagtacagatacggaaaccgcaaatttctttccgggcattcctgtcatatcaagagccttcattccttcaggagccttagccagttcttcctctgtcataacaacaggacggattactgcatgaggacatacataggaacagaagttacactggatacacttggtaggatcccaggtaggaacgttaaccgcaatacctctcttctcgtaagcggaggatccggaaggagtggaaccgtccacataatccttgaatgcggatacaggcagagtattaccttcctgtgcgcttaccttggtctggatattgttaacgaaatcaacaacgtcttttctgtcgccgcttactactgcataatcaaggccttcgtcttcgcagttcttccagctttcaggaacttctaccttaacaacgcccttagcgccggcatcgatagctgcccagttcttcataacaacatcttcgcccttacgtccgtaggtagcctttgcagcagccttcatcagttcgtttgccttctcagcaggaatgattccggtcagttcaaagaatgcggactgaaggattgtgttgatacgtgtggggcccatgcctgtttcaataccaatcttaacaccgtcgatggtgtagaagttgatgttgtgctcagcgatgaatttcttcacctgtccgggcagatgcttctccagctcttctgcattccatgcgcagttcagcaggaaggtaccgccgtcaaccagctcctgaaccatgttgtacttacgtacataggcaggattgtggcatgctacgaagttagcctgacggatcagatatgttgatttaatcttcttatgtccgaaacgtaagtgggacatggtaacaccgccggacttcttggagtcatagtcaaaatatgcctgtgcatacatgtcggtgttatcgccaataatcttaatggagttcttgttggcacctacggtaccgtctgcgcccagcccccagaatttacagttggttgttccttcgggagtggtaaccagctcagcgcccagcttcagggacagattggttacatcgtcttcgataccaacggtgaatttcttcttttcagtgttgccgtaaattgcaacgatctgtgcaggagttgtatccttggaacccagtccgtaacgtcctgtaaataccggaacggaatcgaacttggagcccttcagggcagctactacatccaggtaaagaggctcaccctgtgcaccgggctcttttgttctgtccagtacggtgatctgctttacggtttcgggaattgccccgataagagcgtctgcgcagaaaggtctgtaaaggcgaaccttaacaacaccaaccttggcgcctgttgtcttaatcatatagtcgatggtttcttcaatggtatcatttacggaacccatagctacgattacgtgctcagcatccggagctccgtagtagttgaacagcttgtaatctgttccaatcttctcattaaccttgtccatgtagtcctgaacaattccgggaagagcatcataataagggttgcttgcttctcttgcctggaagaagatatcagggttctgtgcagaacctctctggcagggatggttgggattcagggcacgcttacggaaagcgtcaactgcgtccatatccaccatatccttcagatcttcataatcccatgtctcgatcttctggatctcatgggaggtacggaatccgtcgaagaagttgatgaaaggaatgcttcccttgatagcagccagatgtgctactgctgtcaggtccataacttcctgaacgctgctttcgcagagcatagcgcagcctgtctgacggcatgcataaacgtcggaatgatctccgaaaatgctcagtgcgtgagaagcgatagctctcgcggaaacgttgaatacaccggggagctgctcgccggcaatcttgtaaaggttcggaatcataagaagcagaccctgagatgccgtataagtggttgtcagagcaccagctgccagagatccgtgtacggcacctgccgcacctgcttcggactgcatctcggtaatatgcacgatctgtccgaacatattctttctgtctgcggttgcccattcatcagtagcttctgccataggtgatgaaggggtaataggatagatagccgcaacatcggtaaatgcgtatgacgcatgcgctgctgcatggttaccatccatggttttcattttccttgccataaaaaccttcctttcttatcctttatagataattaaatttttacaatgcatatgcggacgtaatcaaacgcatgcatacgcacttgcccttaaggaaccccttgagggctgttaaaaatttatcttattgatattcaatattatacatctaacatgctccgcatgggtatactgtttttatatgacagttatatattttttatatattctattgcttttttttaccggaaacgctatgcttagagcaggtttccggcaattgtacggaagcggatacattttgtatacaatgtataaaatgaaatacaaacgcatatacatgggaggctgtattatgaatctcaatgtactacgatacgtaatagaagttgaaaaaaaccgttccatcaccggagcagccaggcagctgttcatcagccagccgaatttaagccgcgacatacgggaactggaggaggaaatcgggttttctatctttacccgcagctcccggggcgttattcccacggaaaaggggcgggaattcctggccctggcaaaaagggccgtaaagcagtatcaggccctggaaaattactgcaccagggaggaacgggacaatatcagcctgcatatctgcgtcccccgcgccagctacatcacctgcgcgctcacctcttttctcagcaaaaacgccaggggcaggcagctgtcggtaaattataatgaaacgggaacgctggacgccatcagccatgtgtccgaccgcagcgcgtccatggccatcatccggtatcctgaccggtatgaaaagacgctgctcccccttcttaagctgcgggagctttcctatgaaaccctttataaatttgagctggtggtcatcatgtcggaacgtcatcccctggcaaagacctcggtgctgacccaggatcttctgtcccaggccgtggaaatcgtgtgcgacgacacctccctgtgcacctatctgcatgaatccccggatgccgaccataatgaaaacagcatccatatccacgagcgtggaagtcagttcgatttccttaccggtgtgccgggtaccttcatgtttgtctccccggtccctgattccgtcctgtccagataccacctggttcagaaaaaattccatgggtcccccaggaaaatgacggatctgctcatctatccggaggattacaggccttcgcgggcggaatccgctttcctggaaatgctgaaggaatctgtgcagtgatggggatacaggtatcagacccgggggcccttgtccttcccggagcggtcgtgcccagcctccctccttggccggtgcggcaggggtgttccggtaccagtctcaaaaatgggatatttctaactgtcccgtaaggccataattctgccaacgcagccggaactcctcatgcagcgactgcgtcgtctgcattcgtcagacaggctgctaggggcggcaggattatggtctttcggggcagtaagaaatatcaccattttttccaatggttccggtacactccctgccgcaccggccaaggagggaggctgggcatgaccgctccgggaaggacaagggcccccgggtctgatacctgtatcctcggccactcgaaatgttgtgttgttcttatattgtatggaaagaggatttgatattaagctaaaaaagtataatttgatatagagataaaaaatcccttagcaggttgggtatgtatgatgtggccccaataaagtctaacttattgggggcacatcagtggcctgcgtggggatttttttaatttttatattataattttttgcttataaaaatttttaagactttaattctttgattactttagttacttgatcagttcaggtcgaggaactgttcgtagattcggcagacttcttttgcctgttgttcttctggcatttcgcagaagattcggatcaggggttcggtgccggagaagcggcctactacccagccgccgtttttgaagtagactttgctgccgtctaagtaggagacgtggtctatttcgtaggggagggcggggagttgtttttcttccaggaggattttttgtacggcttcttttttctcctggttgaatttgtagtctctttcttccatgtatatcttgccgcattcggcttcgatgtcggcatagatttcggagagttttttgccggtgacggctatcatttctaccaggaggcaggcggcataaacgccgtcttttccgtggatgtggccgcggacggtgaggcctccggaggattcgccgccgatgactgcgttggtttcggtcattttggcggagatgtgtttgaagccgacggggacttcatagcatttctcgccgaattcctgcgctaccttgtcgagcatgtgggtggtgcagatgttgcggacgacggggccctgccagcctttgtattttaccaggtagtagtagaggagcaccatgatgtcgttggggtggaggaattttcctttgtcgtcaatgacgccaaggcggtcggcatcgccatcggtggctatgccgatgtcgcattttccgtccaggacgaaattctggagggggcggagtgttgccgcggtgggggcaggaagcttgccgccgaaaagcgtatcgtggcgttcatggatggtgtcaacttcgcatctggccgtaagcagtatggtcttgatggaggtttcgcttacgccgtacatggggtcaagggcgattttgagcctgctgttacggatggcctgcatatcaatgttgtctatgatattgtccaggtattcgttcaggggatagatttcctgaatcagtccggcttccagggctttgtcgtattccatggactttacttcctcgtgttcgatcctggcgatgtatttttcgatttcatccgtctgctgggcgctggcgtccctgccgccttcggtgaagactttgattccgttgtatatcgccggattgtggcttgcggtaatcatcatgccgtagggcatttcatgcttcatcacataaaacatgacaaggggcgtgggcgctgatttattcacaagataggcggttacgccctctgcggcgaatacctggccggcccattgcattgcttctttggccaggaagcgtctgtcgtagccgatgacgattcctttgtctgccgcattttcttctttcattttaaggcacagcgccctggcaagaagctgtatatttgccttggtaaaatcgtctccgatcactgctctccatccgcctgttccaaacttaatcataggtttttcctcccttttatgagcgtctgtaaaaaaacgcgttctcgcctccgttttatttttatcccataaccactctgatctggtggtggctgcctgccggaaggaccggtatgcgggaaacttttttctcgtccagccagatttccttcacgcccttcatcacgccgtccgggttatccacggaaatttccatacgggcgccgcgccattcacgggtcatgtagaatttcttccagtctgccggtacgcaggggtcgatgtcaaaatggtcaaactggggcttcatgcccagcatatatctggtggcggaaaagtaagcccatccgccggtgcctgtcataaacggatgtcttgcccgtccgaaggcggtatggtcgcggcccataatgaactggcagtaggaatagggctccgcttccctgatttcaattttgtcgttctgatagtaggggcagagggcgtcgtagaacttcatggcccgatcgccgcgtcccagtacgcattccgccgcccatgcccagggattggggtgggaaaaaatggagccgttttccttcaggccggggtaaaccctggttacaaagccgatatcgtcatcagggaccgtataggagggggcatttaactggatgccgtaaggggtgtagaggtatttatccacgctgtccatggcttttttccctttttccgggctggcggctccggaaagtaccgcccaggaattggattccagatgcacttttccttccttatcctgattcgttccgatctttcttccgtttttggtgatgccgcggatgaaccattcctcatcccacagctctttgttgcatacctcttttacccgttccgccatctgcgtataggtagctacatcctcttttcttcccaggaaggaggcaagatctataaaattacacagcgcccagtaatggaggaaggataccagcgcgctttcgccgcctcccaggttcaggcagtcgttccagtccgcgcggagccccttgcagacgccggttgcgcctacctgcttcgcactgaaatccaggatttttttcatatgctcataaacggttccttccccgccgtccgcgtaggtgaggatttcgtccgcaaaatcaaattctccggtttccctgatatattcaacaagggaggacaccagccagagggcatcgtccgagcaggcgtcagcgaggccatgcacatagtcatccttattcggcgtggggatgactgtgggggatttgaagggcttgacctcgttgtcaggaacaaaccactccggctggaaaaggtgcagtccataaccttctgataccagacctctgcaaagctcctccagtctctgcctgcatttaccgggattggagtgaggtatggtcatggcatcctgtgccgtgtctctgtaacccaggccggttcttcctcccacttcaatgaaggaagcgaaccgtgaaaacatcacattgatttccgcctgatacagagtccatgtattgatcaaagtgttcataccctcattgggggtctgaatctggagtttgtcaaatttgctgttccagtattttttaaggtcggcataggaaagatccaccgcagccgtgctgctgtatttttcccgcatcctgcgtcctgcttcccggtttccttccccaagcatgaaaacaaggcggatttcttctccgggcgccagggtgatgttcttctgcaggctgccgcaatgattgttgcccagctcaaaggagccgccgcactgccctttttccactgcaatggggttatcctccgtccggtaggggccgatgaatttatcccgcaggcagtcaaagccgtccggctcaaaattcccggtaaaatactggaagccgaactcttcataaaaaagatcatgttctataatgccgtcttcataggaagaaccggcgcagtacatgctcatctggaaattctggttgtctatcatgatatggtggaaggagaactcacaataggaaaaaacgctcagctcgcgcactctgtcgctgttgtttttaagcttcacatcccacagctccaccggatcctccaacgggatggaaagcttctggcttgccgcaatgtccttatattcgctttcatataccgtataggacatgccgtggcggcagctatacttcgcttcctccaggctcttgcccacgggctgccaggaaatgctccagtaatccccgtccgcattatcccttatgtacacataatgtccgggacggtccatgggaatgctgtttccccggaagcgggtgattctgtggtattccggcgttttgtaaaacatatagccgcctgccgtatgattcaccaccgcacacatatccttcagtcccaggtaattggtccaggaggtgggcaggtccactctgtcaatcacatattctcttttttcattgtcaaaatgtccgtactgcatatctgctcccatctgcgcatcctttgcgcgcatgcggccttcgccgcgcgtatcgtcagaaggaagggcgctgcctgagcctccccgttcccccgaatgcttcatcatatttattataacggctggggcgtccggaggctatggtcagatatgtgaaaatttgtatataattgttctcataaagcccggttttgcaggggtgtctgtgcagatttaaggctgctcctgagcaggcggggattatgtttatcatatttaacacatgctacagcatatttgaaaattgcccggcctccgccccatacctggaaaaaatgggacggaggccatgaagggaagcagcctaagcattattctgcaaggaggaaatcagggcgggcggattcatcatatggaaggtgtattcttttccgccttcttccttcgaacgggtaattactgtcgctgttttcacagccgcatcgtaaaatgcttccggcgtaatatcggggtctaccccggcgcagagcgcatacacaccggctatgtaaggcacggtccagctccagccgccgtcggcataatatacataggtatctcccgacatgtccgccgtagtcctgccgtccatgggaacaagaaggcttttttcaaacatttcagcactttcccattgccagcttcccagcgtataggtgtccggggaatccggatcccccagcggatccagcttcccaagccctgcaaagggcgcatccgtcccataagcctcaaagaaatcataattcatctccgtagatgtggtaatcacgaatatgccctcgtcactggcatggtgaatggcatccagcattacctgaagctctgcgtccacctcttcattgcctgtaaaattatagcctcttgagatagcgataacacggattttcccattttccggcagagtgcggttcaactctattacacgctcaataacgcgggcgtattccttccaggccacgttcccgtcgtcttccctgtcccagcttttcacattatccataccccagaaatacagggtggcatccggcgccacgccgcaagttttacctacggaaatcgaagccagcgccgcaccgtgcatggaaccggactggttcggaaccacatgcatttcttcataaagagccagattggaagcatattccgggtgcccggtataaaggacctgatcaataattgctatccccactccttttcctgtaattccctgttcatggagggactccatgcccaatcccggagacttgcccttctccagaatcagctgcgccggaaactccttctcaagctccttgggaaaaacagtttcttcattataagtgatgttgggtatacatcccgcaagacggtctttctgtgtctgtttcatcttactgccgtcataccagcggatatcggcaaaatcctcctccaactctatgtatcggtttttatagtattccaccatatccgccgcggcttccgcctgacgggcgatcccggtcccatccttggtcaagctgtccgtaaaggctggcgcctcctttccgtgggagccctccgcattttctgtgccgccgcaggcggcgcacagagacagtatacaaaccaggcaggctattttcataaatcgtttcatgtctttcctccaatcagcttaatcttgtgatattctgcaatatcggtttttatcgtaatattatgttatggcatgggtccgttctacttaagtagaatatatttccatactactctaatagaatggaaatgtcaacggattccggcaaatattcagggtaatgtaacattgccataacggtttgattattttaattgctttacctgctttttggctcctgtttttcagtttttgcacagaaaaaggctccgtacatttccacaatgcacggagccggtcgggtcttatctacactttttctatacttcttatctatacatcttatttgttcatcttacctgttcacttacatcttccaaaagcatctcttccacaatccgcgccgcctccgccacgatatggctgcagggacgggtggcataatacgcagcggtccgctgggaaggcctggcgctttccgttacggacgacggcatcccgagaagctcacggcagataatactgccccttttttcacgaaaagcatcgctcattttccggacgatttcataggaacgcgttttggcttcttcatcggaaggatccgtattccccattttcagccctgacagcatcgccatggcggaaaccgttccgcaaacctcacgcatacgcccgacgcccgctcccatagggcaggccagcttaagcgccgtctccctgtccatcccgaacaggtccgcataagcggcaaagacggactgcgcacagttaaaccctgattcaaacagcataaccgcatcctgcactctgctttccatttccgttcccatccttatttattcttaccgcagcacttcttatacttctttccgctgccgcagggacagggatcattgggataaacctttttatcctttacgatagttgtggaagacttctgctccttgtaaagcgcttttctcgtctcctcatcaaaaatatcgttccactcttccagctcatacagccagtcagcgccggccgcaaccatatttttataaagaagggccttatcgaatcccaggtttacctcggtatcctcttccatctcctcgatagggttggattccaccagactttcgtcgattccgtccaggaagccggtcatcgtcatgatatccacatcatacttttcagccagttcctttacagttcccttaaccacctcatcagggttctttaaaagctgggcgtaaatctctttttccttttcaaaataagcagcccagagcctctgcaaatctcccttgttggccgtttcggaataagccattgatctccactgttctaataatgccatttcttatcacctcatccgtgtattttcaccggttatatccggctcactttattcagcaccttccaatacggaacatactgctgcaggatttaccgcatattttccttgctttcgctcagaatagaaatagtatataacaaaattcccataaagtccagccagacttcccatgccgcgcgacatatacaggaaagttccatacgatttcttttaaaagataaacagtggctttgattgttattttaaagccgccgcctttacatcgcgccgttacagatctaatggcaggcaacggttttacgtgctattgcgtcagtaccttttttcgtttgccatgcgctgtaacgaagaataacaaaagccatacaaggcaatgtgctgacaaaactgttatgtttatccatatatcctgcattttcccggtcagtaagtccattaatccataaaagcttgcgctggacggcagcagatacgataaggcatgtgtaatactgcccatggggacagccagataaaataaaacaggcggggcaaggaacaaaatcattacaatcttgatatatacaatgcctgccataaggccatttgaaaagtgtcctataaacaacccggctaacgcggcaataaacgctgacaaggcaatcattaacagcagcggcagaatcccgctgacagtaattttcatacagacgagggctgttataatcgcagataaaataccgcccaaaaatcctaacgtgattttttgaaacatatactcccattttgccataggcaaaacttcgttgataaaggcaatgccgtcctccttttcactgattatgctcatggcgttaaaggtgcagcccataaacatagccgtaaccattgtaattactatcaacagggatttaagaccgtcgttgttgtccgcagcagggataatagttgtttgagataaagccatgttttccctttccacgtaaagctgagggagtgtgttgccaatcactgtatttacttgcagctcgtcgcctgacagcagcgttttaattccattcctgtcttgcagtacgccaatcgcttgtgtcgcagggtcattgacagcattttccaaagatatcatatcggggaatactgtaacgctgccgtttgtctgcaaccattctattgtgtcattcgtgaggtcattttccaaaatgcaaaatgcagtttcgcccaaagatgaaaagctcaccccagaaagcagactgatagcaaatccaacaatgacaggcagcaaaaaggagagaatacacattttgtcccgccggatatttttaagctgataccttaatcctttcatgttatccctcctttgccatttcacggacaagcacatggcgtacaagcaggaacaacgctatcattgtcagtccgcaaattgtatagtaaatgccatttgcagccgatacaccccaatacgcatttttcattgccataaacagaggatacatggggtgatactttatccaatcccaggcaatccccgtctgtcccgcaagaaatacgggagttgtaatgaaaaccgccaaaacaagatacagtaaagaaaattgcctgaaaccgggcagcagcagcgcgcaaaaaaaacctgccaatgccataaacatggacaaaatacccgtttgtagtaaaacgtgcggcaacacggacagccccaccggaatgcctaaatttatgacggtcaaaagtgttgcaaatacaaggtcggacagcagaaacagacctagcttcgagacgataaacgccgttttgcccacaggcagtaccccgtggacgcggataagccccatttgtttttctttgaacagcagggaagcaagtcccaagaagccgaccgccgttaattcaaaaaacagaaattcacaagtgatttccctgcggtttttcatttccttgttatcctgtccgattatctctgccgcagtatacaatttgggggacaacaaaaagtttgcatatgcggcacggtatctgtccgtactgtctatgccagatgaaaccataataatttccggcgttccattggaagcgtcaatgccgacggcatagccgtccctgctttctgcctgcaatttctctatactgtcaacttctgttatttcagcggacgctgtactttgcgtgtggagcggatcatagagatacaccggatatatgttctgatccaggtttatatagacaaaattaatgtaacacgaatacagaatgagggagccaagcgcaagcaggaaaaacctgcctgataacatcagtttaaagtcctttttcagcaaagcaagaaaccctctccacattatgtcaaccccctccctgtgtactggataaacatatcttcaagcgtcggttctttggagtgaatactgatgatctcgtcatacgggaacggaatacccgccttcagctctggcatttcaatgactgctgtaccgtgctttccctgatatacataattaatttcgacttgatgattgctgttttcttcttttaactttttcggcgtgtcgattgcctttatttcaccgtcagcgataaaagctaccctgtcacaaagcaaatccgcatccatcatgttatgagtagtcaggaaaaccgttgtgccttttttccgttcttcctcaatgatcccccggaacagtaccgcgccctgcgggtcaagtccgcttgtcggttcatctaaaaacaaaagctgcggattgttcagtaacgcccgtgccatgctaacacgctgccgcattcctttggagcaggaagatacaggcttttttaagaagtcctttttaaactccaacagctccaacagttcgtttatgtcgcgccggctgtctgctggataaaatgaagcaaaatagtgcagattgtcgagtgcgcttaaattcgtgtagagatatggaaattcaaacagcacaccgattttctcccgaaagttcttttgctgagaccccaaagccttaccgaaaaggcggacatttcccccatatccttgtagaatgcccgtcaaaattttctgtgtggtagactttccggaaccattcgggcctaaaaatccgaatatctcaccgtcagctacggaaaagttcaacccatgcagggtctgtttttgtttctggtatgagaaagttaaattttcaacctcaatcattcttcatcaccccatttgtcttttcgcttatctttttgttctttctggcgtttgctccaccaattcataaatttaactttgaatggaagagagactgccagcaagataataatcagccaccaataccattccaatcctaaaaacatatccttttcctcctatctgttttaataaggtcagtctatgaaaatgcggtgaaatcgaagtgtggcggctgtgaaatcggtgtgaaataaaaaagccctgcttcatttaagagcaaggcgtttcctcgtttcggctttatgcaattatggagaaatcaaaataaaattcaacaccgtttggtttgttttcaacaccatagtccgtatcacacatggacaggatttgagcgacgatagaaaggccaaggccggagctgttaaaggtgttattttgtgaggactttccgcggtaaaatttctcccaaatcattggaatatcctgcggcggtatctgttccccttgattgaaaattgaaaaccgcaatttactttccctccggataacagataaatgaatttcaccgctatcacaaacatggttttttgcgttttgtatcaagttattaaggacctgctccatgcggtatttatcggcacaaataaaggctttttcgtccggcagttcataagtaaaacggtaatttgcatttggtgtgtctatcagtaaacgtccggcgacagtttcggccagctctataaagtcaaagcgttcctcggacaactttgcggcccccgcttccaatgcagacaaatcaagcagggaaacaatcatagtattcatgcggtctgttgcagataagataacctccatgtaatgctgttttttctgttcattggtttcctctttcagcccctcaacataggcgcggataaggccaagcggcgttttcatttcatgggataagctgtcaaccagttcttttctctgcgtcaatagtaaatgctgcttcgtcgcttctttttcaagctgcttattggctgcttccagtttttcaagagcttcccccagattagaaaacattgtattcaggttttgtgaaagctctccaaattcatcctccgcgtgaatattgcaatgcgctgaaaaatctaactttgccatttgcctcgccgtgcggttgatttcatcgagcggctttgaaataaaacgccccagcatagcgtccacaccgatgataaccgccaccaatagcccaaaccaaataacaaaggctatgcttcgattggttggtaattccgatgtgaaaacataaaaaaagacgataatgccgcccgctaattttgaaagcagcagcacttttttccgaaccgtattcaatccaaaccacgcatttatctttttcatcgtcatacctcaaacttgtagccggaacgtatcaacgtaacgatatgatgcccctgcgcaccaagcttttgacgcaaagtcttgatgtgtgtatccactgtccgggtatttcccccgaaatcatatccccaaatacggtttaacagttgttcgcgggaaaacacttgatttttattctgcatgaaaaaacgcaatagctcaaactccttataggttaagtcaatatcgtcgcccgctgcaataacgctgtgtgaagccgttgctaaagtcagatcgccgacagttaaggtttcttgggtattttcagacgaggaacggcgtagcaaggcattgacctttgctaacagcaccttggggctaaacggttttgtcatataatcatcggcgccgtaatcatagccctttaacttgtcatcctccccctcctttgccgtaagaaaaatgatagggaaattatacatttctctcgctatcttacagacagaaaagccgtccaggtgcggcatcataatatctaaaatcgccaaatccacgggattgtttttcaaaatcgtaacagcgtcaatgccgtcgtctgccgtaatgcaggaatggccgccacgcttcatgtactccataataatatcccgcatatttttttcatcttctgcaatcaaaatagtagccatacaaatttactcctttcctctgaaagattcatttcgttgcccgtcggcgggtctttccgcgtcttttggtatcagccatatatggctgatacgctcaataactggtattctgttatcctcggcagagcttctgtacgcatcgttctgaaataccccattttatcgcagcttccggggcagttgtataatccatatactaattgtcatttctgttttatatcgccaattatatacggactgccgaacaaaatcaataaaactgatatgaacaatatgctttattactgttaatgttttaatatgtgtaatcacatccccaaacaaagatgaacggcaaaatgcagcaaattttgcccctaccgaatggcatgagtacctaaaaaagcggcgttccttatctttcatgggaaagtaagaaacgccgcctgtctggtggtgtgttgtgctttttaaattatttgatgatgtgccacaccatttctgacggtggtttaaggttattttcaaaaggatttcgacggcaaacttccattaatcatgacggtttctgcgtccgaataagctgaatatcctcaggcagacaggaaaccactttatccgcctgcgtttcaacttccagacagttctgtcgcgccgaatagcggaaggaaaccgggccataatatgtcgggatattttgtacttcaaaatcttccttcagccagctttccggtatcccggaaccaatcagcagcgtcccgtcatcttcacgaataagacagtcccttaaaagaaggaatacttccgcagcagtccatccatgaggggttacataattaatgtcatcccagcctcttgtccgctgccaaagctgcgccgaattttcgtcattttccccttcgtgataggtatatagtcctggtgcggtatgggtggataaaaacatttcaatagatacccatgccctgtcttttctgcctgtcagcagctggttatgagcctggccggcttcgaagtacgtccataacggttccggatggtgcactcccccgggacatcttacgttttcccaaaattcatcaaatttatcaagaatttccttatctgcaacagaagcccagcccgcaggccagaaagcacagtttacatccctgtcattctgcccgaaaatctgggaagatttccttttgattgcagctttcagcttttcggccgcagccttccattttttcgcttcttccccatacccggctgcttcggcacaaagtgcagctctgctaagcccaagataggcaaaggagtttacccagattattggataatgattatccatcctgccctgtatcagcccttccgccgcaggaagacacatcatatcaaggtttggttccagcatcatctgcggagtagtgaattctgtatgaatctttaccggtttatcggtttccagcatacgaagcaaaaattccgccttttttcttatgtggggatacatatcctccaggtattcctgatcccgtgtcaacagataatgttctgacagaatccatatgatttctccgggagcatctccctccgatccaaagccaccaaatgcatacttttgagcaattcccctgcaggacgcctccgaaaattcgtgcattcctcctttgttcagcgcattcaccacatatgctccgtcacgaagccaccagagtggataggaaacaggagaaatgcgcggatcatcatgaaccgtaaacatatacaaatgcaccagctggcagtaaaatgcatccgtaaatctcttatccggcagctgcaagcctattttaagtttctttttccagaaagtgagcaggcgctcttttgtctcttcccaatggatttcttccgtataggaaagattctttccaaccatccagtgtcccgcatgcagcctgcacataaaatcataaatgccgctttcccccggcttcaggcagtatgaatagacaagtacaccgctggcccagccggaagcatcctctgtttcccattgtccgggaagctgtccttttttcagatagcaggaaatatcttttccagtttttgcataactcaccgttcggaactgttccggctcttttcccataacaaacacaggagcaccgtttattttgacgcagtgggtactgcttttcaagctgtgaatggctcctcctgctgccccgaaggaacgaatagggataaacaaactgccctgtgccgtttcctcgctggaattcgttaactcaatcctgtaatagtccctgatatcactgatttgcgtatctccctctgtaaaaagacgggaagtcacccgtaccttcccgcatttaaaacaggacgtcaataccggcagatgacctgcttcaaatttccattccaaatccgtaagaggcatattttccggggcatacagaaccccatcctcatatatccaggaagatatgccataagtaccaggaccaggggaaaaagaatttcccggttccacaggtgtcttgaaagcgtccagtgttccgggaacgcccaatattacatgagtatcgcttcggttccatatccaatccggatgcttttctttcatttctgccattgacgcatgttcaagcatcttatatttcatctcagacttcctcctatatcacttccaaatcatttacggtacctataaaagggtatggctgatgcggttcactttgataccaataggccacagaagcaatatcatcctgtaaaggcagatatcttccctccgaacgccagcccaatccctgtactgttaccttcagttcctcttcaaaacggatcggatccggcacatggaaccggtacattccaaatcttgtatttcccttcaggaagccatccggtttaattacctggtgaaagcccagaaatgccgaagtataatccccatactgagaattatttccctcaaaagcccacgctccgccaaaataatcttctgttcctgttccacaaatcgtagggaattccttatcgccatccatatagaacttcatttctccttctccccaccagccattgctattggtctgccatgccagatacgttcctacatactgtcctttaccttttaccccatccagaattgtatgcacgtccatatatttaagaggattgcttcttctccactgggcatgaaaatacgcagcattatccggcacttcggccagagaataatctatctggaaaaagaattgcggaatatccctgcttccgatgttctccacagtaatcctggcccgttttctgaatggcatcggccaatagctgttcataccccctgcagtcattacagccactggcagcgcgtttacaatcgttctttcgcaccaaccgcagcaataaaaatccccaagcggacactccacggacggcgtttcttcctcatcccaggtaatccggagaataatgctcctccataattcaggcgcacaggtcatccacatgtgctgtatccatccaggtccatcaatctctgccaggacaaaggagctttttgctcccagaaaaattgcaggcgaaactttccagccctgccccagttcacgcgcacaggacgcacccacgccttccaacgcttttccgcccattcctttttcccctgtaaaattttctgcgctgatggaacgcgattttgcatcagacataagtgcaatatttcccagtcccatccctatattgtttaattccatagttatatcctctcatttccatttaatcagttttcagcccttaattcctccggcaaatatatccggaactatgtatttggaaagacttgcataaattatcaaagtaggtaccgatataattaatgctcctaccattattgttccccatggtgtctcaaacatctgtccctgaattcctgccaatgccaccgggaaggtcagctttgattccgtactgagaacaataaacggccaaaaataatcattccacgtagtaataaatccattaatatacacggttatcatcatcggccgaatcagcggaagcgctaccagccagtaagaacgaaagcttcccgcaccgtccatcctggatgcctccagtaattcatccggaacggaatacatggcctgacgaaataagaatacaccaaatgccccggccattgcgggaagaataatggccagataagtgtctgtaagccgcagtctggacatttccagaaactggggaatataacctgctgttgaaggtatcagcatagttcccaatacagccccaaataaaattttatctccccgaaaccgaaactttgcaaaagcgtaccctgccagagaattaaagaaaagctgcagcactggtataataaccgcaagcagaaaactattcagtatatttcggacaaaacagggaaagtaaaccggcaggcgctggaaattttccagtgtaaaaagattgggaatcagacttggaggataggtgaatatttccgaaaccggcttgaaagccgaaacaagattccaatagaaaggaaacaaggaaattgcggctattgctcccagcaaaataccaataacccaattatgtatttttctttttttattcatcatttcacctccctgtcttcccgaaacagtttgaactgcagcacggcaaaaaccgttgttattacagctacgatcaatgacatcgccgctccatatccatatttcagattcgcaaatccttctgaataaatataaattgcagaggtccggcacgcacccaaaggcccgccgtttcctaaagctgccccagccttgttaaacagcagaaacggctcctgaaaaatattccagcctgcaatggtcccggaaaatgcctgaaaaagcagtatcggaagcatggacgggagcgtaatataaaactgtttttgaaaatatcccgcgccttccaatctcgcatattcatacaaagattgatcgattcccatcataccggccagcgtatacaccacgtaataccccatgcctctccagataataagtataatcgtggagatttttgcccagacaggatccgtaagccatgacacaccatttatccccaaagcatttaaaaggaaattcagaataccgaaattttcgtcgaacatcagctggaagatcagtataaccgctaccaagttcgttactgttgggaggtaaaagacaccggacagcataccgcgcagccggggtgccagacttaccataaatgatgcgatgataaacgcaattaccagttgcacaggaagtgtacaaacccaaaatattgccgtatttttcaaactgtcccaaaagatagggtccttcagggcatcgcaataattttgtaaacctacaaatgtaaaatctgagccgaaccgcacatcaaatacggatagccacagagaataaagctgagggaacagctgaaatgcaatgtatgtaagaaagaagggcgcaataaaaagatagggaacgcggcttttttttatgccgctgtgtttttttgctgtactcatatttcttttcctcgatttgagagacggacagcaggcgacaggcctgccgtcccaaaattaaaattccttattccagtttcagctttgttttgatctcttcctccgcactgcttaaagcggtatctgcgtccatttttccaagccaccactgctcataatatcgctgccagatggaatccgcttcggaagaatccgcaaagaagggaggaacataggtggaattggaaaaagcctgtgtagccagtttccaatatgcttgatccttggcaaaaaattcatgcggctgatttacatattcattttccagcgctgcattgcttaccacggaaacccctaattctttcaaaccgatttccagagagcctttctcgtccagcgtccatgctttgcaccattcaaaagcggcgtccacattttttgtctgagaactgataaagcaggcggtggagccgaaattagggtacctgtctccgccctcttctaccgcaggaaaaggtgtaaaataccatttgcccagagtatccggagcctgctggatgagggtctgtacaaaccaggtgccgtttccatagcaggcaactgttccgtccttcatactctgataccagggcgcgctccagtcatcaatgggcgcgctgatttttgcgtctctgatctcttggagaagggaaagggcatctttgtagttctgggaattgattgctaccttatgatccgaattcagtatctgcgccccatattgctggaaaatagtcatatccaacggaactcccaccttatttttcggtgcattgaaccacattacctcgccgttgctttcttccaccacttttttgccggcctccagccatttatcccaggtagtcagttcttccgggttaattccgtatttttccagaacgtcatatcggtagaacattccgcctgccgggctgtttgcaggaattccccaaatctttccttcataggtaaccatgtcccatgccacctgaggaagacaatctttatagggctccaccaaatctgtaatatccctgatagcattttgagctacaagccgcggaatatcttcatttcccagcttgaaaccatccggcagtccatttcctgttgcagccgccacagtcaatttggagacttcatcttctctggccatagtctggccattgaccgtaaccccagatgcttcctttacataatcctcaattttcttattaaactcaggcaaatcccatccccataccactatggtctgaccttcggccttacgggacattacactattgttttcctgagaagaagcttcttctgaactgctgtccccgctcttttctgactgtacggtatctttctgcgtttcggcagcttcggatatcacagcagcattttcctgcgctcctcctgtatccgctgattccgaacttttccctgttgcgccgcagcccacagtcaaaccggctgccaatatacatgcacatacaatccccaacacttttcttaacatatacatacctcccgttaaaatttaaaaactggaagtacaggacttcttttccataacttctatacatattatggtaaatatgttagaatactctcgtagttgatttgttatggcatatccacatcctgtgccagcaggtgtgggtatgttttttataagacagtttattttattactgcctttctgtccctcttccgcactctgttctatagtaataagccacgattccgtgaatcctactccaattcctcccttctcttcacagatttccgaatcgtcagtaccggctccatactaatcctagatatttgattcttttgaattttaccttctattttctttatcagcagctcgcacgccgttttccccatatcccggataggggtagacattgtagtcagaggcggatccaaaacagcccccaaataaaccccctcataaccggcaatagaaaaatcctctggtatccggcagcccaaacttttcatatccgccagaaaagccgccgccaccacatcgttgcagataaaaaatgctgtaggaactttatctgaatgcagaagctccataagctcaggattcttctcctccaccgttcttccgtcaagggaattatcataagggattaccatgatttcctcaaatccctgactcgtttcttccatagctttctgataccctctgcatctattctttacctcggaggaatttttcaatcccttatcatatatgtaagcgattctttcatgcccctgttccaaaaaataacgtgtcatgtcatatccgccttttagatcatcacaggtcacgtaatcacaatccatgtcctcaaaatatttcgtataaagaacaaaagggattccctgttccttcatcttcttataatttgtactgctcccgcaatgaaatacgagatatccatctattcccatttcctggtatttacgaataatttccgtttccagcttcttatcgccttccgtcaatgcaatcgtcagggtataccccttacccatcgcatagtctgtagctcctttcagaaactggttatgataatcatcatgcatatcgccgcccactatcgcagcaatcgtatacgtccgcccgtttaccagtcctttggcaattcggttgggcacgtatcccaacgtatccgcaatctcctttatcatattggtagtttccctgctgatggaaggatcattacgcaacgcaagggacaccgtcattttggacactcccgccttattagcgatatcaatcagtctgactctatttcccattgccattctcctttaccggtaaaatataaatataaaaaaaatagcccatgatcccacctatttatctgtttttcatccactgaacataatcagcttctttctgcttcctttgcataatatcaaagataaagcaaataataaacaagtttcccggaatcactggcatgtatccgcagcatatgatatttttgtttttctctgttgtagtaatcataatctattttatcggtaaagtcaataccatacaaatttattttttttattttctgtgtatattatttcaatgcggggacatactgttaatatcatcggaaccccctcctttgatgattcataaaccaggcggctctgccgccggtttatgattacgcaagataaataattacttatcctcccattgcggggaggattcctcccctagttcaaagtccctcctgcagcagcagtgctgtaggggggactttgcttttccgccgcaaaaattcacacagtcttcccttattatcatctgttcttaactccatagaatacctccccaaaaattcttttccacttccctatccctcaatattacactttgttctttaccatatacctttcccccacttctatgtccactcccgcataccatttcttcatattttgcttgaaaaccaaagtaccgcaagcgcaacacatacagaaaccagacatcaaagaacaatttgtaacagttcaaacaggccaacgcatttaccgcgcaggccagcgcttcgcgctaaccataagaaagcgatccaggaatgctgaaatccatcccaaaaggccctggccctccacacgaaaacattgctctttttgttgtattgatatatcataggagtagagcgtcccacacacagggaccgcaaacttgcaaagtgaggtatcacctatgaagcttaacacaaaacggaccattctggtcggtctggcctttctgtcgatcagcgccttctggcagctctatgacagcatcatcccgctgattctgaaaaacaccttccacatcagcgacaccatttccggcggaattatggcgattgacaatgtcctggctctttttatgcttccgtttttcggaagcctgtccgataaggtacatacgaagctgggcagacgtacgccctttatcctctgcggtactgcggcggcggtaattgccatgcttttcctgccctttgcggataatatcggttccctggccctttttgttgtggcattgtgcgttacgctgattgccatgggcagctaccgttcccctgccgtttccctgatgcccgacgttacgcccaagccgctgcgttccaaggcgaatgccatcatcaacctgatgggcgcggttggcggcgtgatttccctgatcctgatttccacgctggtaccgaaaaccggcaagcccaattacctccccattttcctgatcgttgcactggtaatggttgccgcggtgctgctccttttatggaaaataaaggaaaatccgctgcgtgaggaacgtgagaaaatcgaccgtgatctggatattgcagagggtacggtggaagaaacgcaaaccgccaatgcccccatgcctcctgaagtaaaaaggagcctgatactcatcctgatttccgtttccttctggttcatgggctacaatgcggtaactaccgctttttccaaatatgcgcagatttactggggaatccagggcggcggctttgccaactgcctgctggttgccacaattgcagccatctgctcctatatccctgtgggagccattgcttcccgcatcgggcgtaaaaaaacgattctgggcggtatagtgttgcttgcctccatgtttgccctgggcgcgaccgtaaaggaataccatgtatggatcaacggcctgttcgccctggttggcgtggcctgggcggccatcaatgtcaattcctatccgatggtggttgaaatgagcaagggcagcgatatcggtaaattcaccggattttactataccttttccatggcggcgcagatcgtcacccctattctttccggtttcctgctccagcatgtaggctatcatactttgttcccttatgccgcgcttttcgttacggccgccttcttcaccatgctttttgtaaagcacggcgacagcaagccgattccgaaaaaaagcaagctggaagcattcgatgtagatgattaaaaagccattgatgcagatgattaaggagataaatggaaatggataaaaagaagaaaacaccaaagcagattgcggcccttgtatgcgtgggcctgctgctcctgctctatctggcaacgctggtggttgcatgcctgaactttccgggtgccgaccgcctgttccaggcctgcctggtggcaacggtcgggcttcccatccttttgtggatatatatctggctgttcggcaagattaaggaacgcaggcagggtcaggataattccaacggaaaataaatactgaaaaaagaaagccaggctgctatcccataccgcctggctttcctttttgttttcgggcagagccttgccgctccgcccgtttttactgctttttcctgatacctgtaaatctcctgacgaatctattttaccgcaaatcagtatatgctgtctacacccagctgcaaaagttcctcctgcgcctgcttcaggctccggaaaaggatggtatgtatgcccagtccggctgccgtatccagattggactgtatatcatccaggaacacgcattcttccgctttcaggccatacctgccaagcaaaagcctgtaaatcgccggatccggcttgataactccgtcccggtaggaaaggatgccgccgtccacatattccaggaaatccatggcatcctcgttgtcccgtttcaccttatcggaaaaattggagaggacaagcacctgataccctgcgcttttcagcttctgaatccagggaatcgcataatcagcccttgttacaatgccatgaaggctgacaaaaatctggcgtatctccttttccacggtaggatcattgtttatgaacccggccagcatttcgtcatcgcttaaaaagcccctgtcaaactcatgccagaacggattgtccaccgttgcctttcccaccctttcctcggtttccggcgggaaaccgaagctgtggataaaatttttccagccgaaaaccgtcagcacgttgcctatgtcaaaaataaccgtacgaatcattcgcgtccctctctgccttatcttccctgcgtaacaaatccagcacctgcgcgcggctggtttcatgataaaacaccttgtattactccagcttctgcagcatccgtttttcctgttatctgcaaagagcgctctgtctgtaaataatatcctctctgccggggccgttgctcaccatagtaatgggatagccgatatgcgcttccacgaactcaatatattttctgcagttttcaggcagttcctcatatttcctgatgccccggatatcgcatttccagccgggcagcgtttccaggacgggctttgctttttccagcttccaggtgaccggaaagtcctccgtcaccgtgccgtccacctcatatcctgtgcacaccggaatctcatccagatagcccagcacgtcaagaacggtaaaggccacgtccgtagttccctggagacggcagccatatctggaggccacacagtcaaaccagcccatccggcggggacgtcctgtggtggcgccgtattctcctccgtcgccgcccctgcgcctgagttcctccgcttcctccccgaaaatttcggatacaaacgcgccggcgcccactgcggaggaataagccttgcatacggtaaccacctgcctgatttcatagggcggaatgcctgcgccgatggcgccataggcggccagcgtggaggatgaggttaccatggggtaaattccgtgatccggatccttcagcgttcccagctgtccctccaggaggatatttttcccttctttaatggctttgtccagataagcggaggtatcgcatacgaagggagcgatcatgtcccggtattcctgcagggttgcatacagctcctccacatccagcagaggcttgtggtaaagatgctccagaagcacatttttcgtttcgcatacactggccagttttcctttcaggccttccccatcaaacagctcgcatacctggaagccgattttcgcatatttgtcggaataaaaaggggcaatgcccgacttggttgagccgaaggattttccgcccagcctttcttcctcatattgatcaaaaagaatatggtaaggcattacaatctgcgcccggtcggaaacaaggatattcggcatgggtacgtttctgtccgtaatggaatgtatttcattgataaataccggaatgttcaacgcaacgccgtttccgataatgctcgtcgtatgtctgtaaaaaacaccggacggaagggtgtgaagcgcaaatttgccatagtcattgacaatcgtgtgtcctgcgttcgcaccgccctggaatcggatgataatgtctgcttccctggccagcatgtccgtgattttaccttttccttcgtcgccccagttagcgcctaccactgcttttaccatttcttattcctcctgtttcaaatctgcgtccccgaaaggacatctgcctgccgcagattggcaaaagtgccgctccacaacaaaaaaagcgggcttttacaaaaccatttttgtaaaaaacccgctttctgcgtcttttactttatgattatatattattattaaccataagtaaaatcaatatttattatgtaagaaataagtacagcttatagatttacctttttaaatcagtcataaaggttgggagcaaccttgggatcgtccatgttttcagcagtataccactggcatcctgtatcaacatcacttacgggctcgcccttgatggcctttacacacagctcaacggttttgtagccaatctgcagaggatcctgggtaacagcgcctgccagcttgccttctctgactgctgttttaatcagcacgccggagtcaaatgcaacgccgaccacgtccttgcccagtttgccgatgtttgcgtcaccgttaatcagaccttcacctgagaactggttggagccatagatgcagatggtgtcaggcttgtttaacaggttctgagcgtcaacggaagaaaggtctgcacttacggatgcgggaactgctacgtcgatgataacatctgcgccgtcaaccttgtttgcccatttgtcatggccttctacggaaacggtcttgccgtctgcttccagaagggatttcatcttatcaacgaagcctgagccacgctgtacgatggattcggagttagcttcctggttcataacgccgattcttacggtgccggttgcggatgcaactttgtctttgatcagcttgtaggtttcatcagcagccagttcgcctgctttgtagttatctgttgccgcattggcaacgatagcgccttcgggagcaccgggtacgccagagtcaaagccgacaatcgggatgcctgctttctggatttccttaatcgtatccaggcatgcttctgtatcaagagctgccaggccgattgcgggcggattgttattgaatgcgttgttcagcatctgtacctgctgtgcgatatcggattcggtatcgggtccctggaaatcaatttcaacgccgtattccgcagcagcttcatttgccccctggagcactgcctgccagaactgatgctggaagcccttggataccagatagatctttcccgtaatttctgtagaagcctgtgctgtatctgccgctgcttctgaagaagcaggctctgcaggcgcttctgattttgtctccgcgggcgccggtgtggacgctgcaggagccgttgtggaagcattgcttccgcagcctgccagcatgcttgctaccatagccgcacccaatgcgatactgagtaatttctttttcatgtaaaaccctcctttaaatttgaaatacccccggctcttcttccgccggttttgtaatcaaaaaccttcatatcgttccttttttgatatgacaggcattacaaacattttctgtaactgtctgaaagcttcctgtttctgctcagacttttttctttttctgtctgttcatgacatccatgaatactgcgaacaccaggactacgccggtaaccgcctgctgccagttgctctgcagccccacaaagggaaggccggtcttcagcacggacatgataaacacaccaatcagggtaccggaaatggttccgtagccgccgctcatggaagtgccgccgattaccacacctgcgatggcatccagttcgaagccgccgccccctccgggaaggatggtggaatagatggaggcataggccaggcctgccaggcctgccagcgtgccgctgatgatataggcaagcgttctccattttgcaatgttaacgccggaaagccttgttgcttcactgttgctgcccaatgccacgatataacggccgggccgggtcttattgagcaggatggacgccaggatggcgataacaatcaggagaataaaaccggtggggatcaaaatgccgttctggttgattttgaagatattgcggaaccagccttccgcctggctggactgcggccaggtaacgctctgcgccttggtaaaaatggaaccgaggcctttggaaagcatcatggaacccagcgttgcgataaagggaggcagatgcatgtaggacaccatcaggccgttcagaagcccgaacagggcgccgatgaagatacacactaaaagccccagggccacaggcagatgatacttggtaatcagctgtccggaaatcaatgcggaacaggtgagcacggttccaatggaaagatcgatgccgtccgaggtgatggcgaaggttacgccgattgccatcagaccgatataataagaggcatcaaaaatgttgaccagtgttgcataggaccggaatgccggattgatgaacccgaataccaggtacaggataatcagggccagtaaggcgatcagcctctgcgtcccgatggatttggtaaatttcgcaaggggatttttctttacggcccctcccgtattcgttatttttgccatgtttttcctccctctttacatgcctaccgtagcggcctgcatgattacttcctgtgaagccttctctatcggaatttccgctgtttttcttccctcgcacataaccaggaccctgtcgctcatgcgcaggatttccggcagttcagaagaaatcatgataatggacttgcctgaggtggccagttcgttcatcagatgataaatctcgcttttggcccccacatcgatacctctggtcggttcatcgaaaatcaggatatcacagtcccttaccagccacttggcgataaccactttctgctggttcccgccggaaaggctgagcgtgggcgtggtgactgtgggcgtcttggtattcagacgctccacatagtcctgtgccgtgctttcctcgcccttcttatctataaacaaacccttcacaaatttttccagagaggccattgtggtgttttccgcaatggttttatccagaaccacgccgtaacgctttctgtcctccgacaggtaaccgattcctgccttcactgcgtcctgcgggctgttgatttccacttttttgccgttgacgtatatatcgccgccctgcttcttatccgcgccgaaaataacccgggcggtctccgtccttcccgctcccatcagccctgaaaatcccaggatttctccctttctcagttcaaagctgatatcctgcaccattttaccggcctgcagatgttccaccttcagcaccaccggcgcattgtccgggacattgcttacggactttggttcctcataaattgtccgccccaccatcatattgatgatatcgtccttggtacagtccttgcttatcagggttcccacatactccccgtcacgcatgactgtgactctgtcggtaatgatcttgatttcatccatacgatgggatatgtaaataatgccgattcctttttcccttaaatccctgatgattttaaacagctcattgatttccgaatccgtcagcgccgccgtaggctcatcaaataccagaacctttacctctttggaaattgccttggcgatttcacacatctgctgttttcctacggtcagatcacccatcacctgggaaggatcgatactgatattcagcttttcaaacagcttcgccgcctcctcattcatccgcttgtcgtctatgattttacccttcatatactcccggccgatgaatatgttctgagccacggtcagctgctgcatcatattcagctcctgatgcacaatagcgattcccgcatcctgggcctcccgtggatgcgtgaactccacttccttcccttcatatataatctgtccgctgtccttggaatagatcccggtcagaattttcataagcgtggacttgcctgccccgttttcacccatcagggcatgtacctcgcccctgcggacttccaggctgacttttttcagagcatgaacgcccggaaaggatttatcgatatccttcatcgtcagaataacttcccccactttttcaccttccatcccttctcattaattactgctttctttctcatcactcaagcctatgtttatagtatagtggcatcttccccaacactaaatgtgatttcttacaaaaaaagggtaaaaatttactgttctgtaaatttttaccctttttacaccacaaaagccacaaaaaagttcaatttatttgttgattcttgcaaccgctttcatatttcccccctctattctcctttaaaagggaaaagcatttcctggttttcgtccaggtacatgttgtcacgggttatcagtacggaaccggaatcgatttccctgggcactttttcaccgttcagcaccttcacggcggtttccacacccagataccccattttgaatggattttggatcaccatgccctggaaaattccagcctccagcattttgatttcttccagggagctgtcaaagcccacaaaactgatttctcctgccaggcctttgtccacgatggcgcgggcggcaccgacggcggagtattcattcagccccaccaccacgtctacatccggatgcttttccaggacgcccagcataagctgataggccttgtcatagttcgaatcacagaaaaccacatccgcaattttcccctgctcctctcccaacccttcccgcaggcctttttcccgttcgatggccgtggaagagttttttacatgggcgattacggcgatttgggaatccggtttgaggatctcccgcacataagagccctgcagctgccccgctttgatattgtctgtggaaatgatgcattcttccacgtcctcattgatttccgagtcaagaaggagcaggcgtatgccgctgtccacaatcttgcgggccagcggagtggtttccgtatagctggccggcgtcaggacaatagcgtccggatgctctgaaatcgcctgttcgatcagaatgttctgcatttcataatcgtcctcagcctccggcgcacggacggacagttccacgccgtattcctgcgccgccgcttttgtcccatctatcagctgggtccagaaatcgctgtcgtcaatgatcttggaaataaaaataatggagtacggctcttttttgggttccttgcgcataaacgccagaagcaaaaccaccgataccgccagcagaagaaatatggccgacagaagttttttcttatttatcttcatttgtttcctgcgcctcctcttccacaaacgggatttttatcgtggctgccgttccctcgccggggatgcttttgtaaaaaatcccatattccataccgtaataaagctggagccgcatctgtacgttgcagattcctatccctgatttttcttccccattctttgcatcaaagatatgatccagcacttcctgctccatccccctgccgttatcatatacggtaaggtaaatacagccatcccggtaggttccggttatttttatcagaccctttccttccttatatttgattccgtgataaatggcattttccaccaccggctgcagcaccagcttgatgatctgctggttcattatcccctcatccacatcgatttcgaattccattttgtcctggtaacgcattttctggatggtcaggtagcttgcggcataatccacctcacgcctgatggaaacaagctcgtcctcattgctgatgctctgccgcagcagcctggccagggatgaggtcataagcactacctcactgttcctgccgccctccgccatccagatgatggaatccagcgtattgtacagaaaatggggattgatctgcgactgcagcgccttcagctcactcaggcgcttctgttcctgttcgtagatgttctgctccatcagctgctgtattttgtatatcattacattgaaggattttcccagcccggcgatttcgttatttccctccgtctctacctgcgtcccctcaaaattgccgcgctccacctctttcatggaatttttcagccgttccagcggacgcgtaatcgctgaggagaataccacgcacagcagcacggttaccaccagaaatcctgctgtgataataacatacagccgctgtgcctctgagcgccccttcataagctccgccatatccgttacgcccacaatgctccagccggttttccccgatatggaaatagtatagagcttgccgcccgtcccttcttttttcaggaaataaccatcctcgcattccagcacttcatccaccatttctgttttcagggagctgtagataagcttctgcttgggatggtaaatgattttgccgtcaggatcaataatataaatataatcagatccgatgttattgcgctcacacaggtcttccagcgccttatagttcaaatcgatgaaaaaaacgcccaccgtttcccccgtatccgggttctcgattccgcggctcatggtaattacccatttataattatccttaatcacattctgcacatgtgaggaggtgagccaggtcccgcccttatccctcaccttgccgtaccagtccacactgtacaggggaatgttcacattaaggacatcgtttccatcattgatgattcctttatcctcttcggaaaccacggcaatattggaaatatccttccgtgtttccagtaccgtggaaaactgggtcacaatcctccggtacaggttgggatctcccgcagattttttatccagcaggtagttctgcacatcactgctgtgagccaccatggaggatatgttttccatataatcaatgtaggaatcaatgtccctggtcacctgcccggtcaggcgggtggtataatctatggaattatttaatatcgtccgttccgtatagttcagggatataatgtaaaaaaaagtgagcgttgccactatcaaaacggaaaacaccgccagcatgttggttctgatgctggaaaagggcagctttatccggcggccccccgctttctcctgccgtttcatcacatccccctcttttccctggcgtactctgtaggtgattttcccgtagcctttttaaaggcggcgctgaaataatgaggatctgaaaaacctaccttttcagcgatttcataatttttcagagcggtgttttccagcagctccctcgccttctgcatccgtatgccggtaagcgcctccatgaaggtttctcctgtgacgcttttaaaaatggcgctgaaacggctggtactgatattcagataagagcatatcgaattcagtcccagttcgttttccccataatgtttttctatgtaatccatggcaaggagcgcatatttcttcccgccgtcatttttccccgtatccagcatttccgccgctttccggtagtagccttccattacggaaagcgcctgttccaggcttacggcgctcatcatcccttccagcgcccgttctttttcccagacgatgtcctgctcctccagctgaaaggaacgcagaagctccggaaccgcatccagctgctgctgcagatacatgtgcaccctttctttcgtccagccggctgtgcggacgccttttttcattttttccataatccgggaaacagattgggtatcgctgtgcttgacggcatccaggatttcttccgccgccagctccgtttccgtctgttcccctgtatgctgacggatatcctccattacaaacagggactcctccccgaaaatatagcggcactgaagcgctgccagcgcatcttcataggaatggaacagatcctgacgttccctgatacagccgccgattccgatattggtcttcattcccaggatttccttcagccgtccgttgatctcctccgcaatggcccggctttcccggcagaactccaccggcttattgctctccagcaggaggaccgtgcggtactccttcccctggaatacctctcccgcgccgtatttttccacaatttcctgtgatacattgtatacgacaaaggcgataagggcgcgttcctgtttcttcttatcatccaggctgtgcacatccctgtagtcctctatctctatcactgcgacccggaaagcattcccccagagggttattcccaattcctccagctccctgtcattttcctcacgtgtcttgtctcccatgacaaggctcatgagcacatcggagcgcacaaggaggtggtttttgtgataggtggtgctcagcctgccgataagctcttcatttttcctgcgttcatctattttttcaccgatttggatcagcaccccggacagctccgaagcggtgaccggcttgagcagatattcggacacctgatatttcagggcctgcttggcatattcgaattcatcataaccgctgaaaatgatgatcttaatctgcggatattcatgataaaggaattcgctcagctggaggccgtccatatatggcatacagatatcagtcagaaccacatccacctcatggccctgcacatagtcccttgcctccctgccgtcggcgcagaccgcaaccagctcatatcccagcttttcccacgggatattggcgcttattccttctcttgttaaaatctcatcatccaccacaatcgcttttatcatagttcccccggtattccgtcagccttccaagtccgccccatacggactttttgcctgtcttatctttatcataccggaaaaatatggaagtgtctatgaaatgttcttttttcatctttccatctgaatcaaagacctcgcggcagtcgccaaatatccatgcaagcatggctacttggctcgttgctcgcaggaataaaagcatttattgactcacaaccacttttttaatctgcagtaaaccttttcctcaatctcttctgctatagctctggctttataaggatcaagctttatatcctcagcaacagccagcaaatcctttattcccggattttccccatttccattcactgttgttgcatgttctccgccaatagaattactgtatgtcaagtcatatgctggtgatagaacccattttttctgactttcatcataaaggaatgaaaaatttttggaatggtcatctctgttatgcgcaaaaacattaaaacacataagacgataaagctgctccagctggctataatcattcgtcaatttcaaagtaagctgcatcagaatattataatccaaattaggaattctatgagatgtttccagcaatgcgctgacagaaaccatatgaatcctctttcccccatttctgtcaaatcttttagttgcgaagtaaccctgacaaagcttacttggcatcaaccgggtctcctccatcctgatgccgcattcttttgcgcaaagagaatactcatattcctgtacccctatgtttcccttatcataggaagacgcaaacttcactatccattcttctccatcaataatataatttaccttgggtcttgccccgccggaagaaccgcctaattgaaaaagctcatcaagattttcactatcattcgatttcataatagcctcgcagcctttggccaggtcatccaaagatacgtccttatcatcggagaccagcttattttcagggtaataagttaatgctcccataccggaggatcccactattgccaagcggttcaatgcatctacctttacaggattcataccttcttttcgcagcatcctgtccaccagcaatcttccccaaccatccgggaggctgtctgcaaacacgccaaaggttccttcaaacggatcaaatcctttgggagtaaaaaccccggactgaagcggcagagagaccgggctgaccgaaaatccgtttcgcagccaatccgcatcgtactcaaaggctgtgagcttatcttttgtaaccgcaagcgtccctacttttcgcttatccataaatacagacaacattttattatcgttcatttaagacctcctcaatggacgcgtagcctttttttgtaaacagcccgtcaaagtcgttttcataccccaatgcaaatgcaatttttatgagcgaagataatgatatctctccggtacgttcaaaacgttttatggatcccaaactcacatccgaatatttcgccagctgtacctgtgttatttttttctcctttctccttctgctcatacggcctgcaatatctttacttatttctcctggtgatctcaaaaaatcaaagttattcatagctaatattttaaccttttttgtagttttaatcaataaaagattaagatattattcttttttattattgttctgtttctgttcactccgaaaaccagtaactgcataaatccagtaaaaattgcctgcagcaatgggatttatgcactcttgaatcactttcttacatactgtgcagtaaatgcacagtactgagtgaataataacattcatcatcagccgcgggatgtatctgcggccggttcccgatcctggaaccgcttcagctgggcattcagctttttgacctttttatccgccgcaagccaaaggatgccctccgcagccaggcagacagccaaaaccataaccataaagggtaaaagtgtattaaaatccgtccctcccaggaaaaatacgatgccaaccataatcgcttctatcaaaataagctgtatgattttgcggagaagcatctgcttcactgtaagctcttttctgctgtagagcacggctgagggcagaatccccagaaaaccgtagaacaccgggaacagaagggcctcatagccaaacctggtatccggggcatagatcatccccataaaggccatccccaggtttatgcaggttaccacgacaaaaaaactgataaacacctgtcccataaattcctttttactcattttgcagcctcgctttcaacgcatttacatattttctggaaataatgatgtcctcgccgttcgtcagccttgcggagagccgcccgttcaggccggggcgcaggtacgaaacccgcatcaggttcaccaccgccgttctggagcagcggaagaattccccggagcaatagttttcttcaaaggtatatagtttcattttaagctcgtacacatttttttccgtataaatatacaggcggttgtccacggtttccgcataatatacgtccgaaagcggtatgcagtatattctgtccgtgtcatagccctccagcttttcctggcgcagcttgacgaagcgctctatttcccgtatgctttccgtcacctcatggcattggatcaggacctgttcttctttttcccggccaatctgttccaccgttacgcgcattgcctgttcccggatccgcagctgacaggcgctgccgcagtcaggcgaatcctttccttttctgatttttaatgagtcttcctgtacaggccttacggcatctgttccgcctgcggtacggttatgcgtggctgcgactgcatgcgggcctcaagcgggccagggatcggaggcatgccggaaggctgccggaagactgccggaggactgtgctgtttctggtttctaatacgtttcctgtagagaaagcgttccctgtcccttcagataataatcaaaataatccctgatgattccgttcatcgtgaccagacattcccccgcatccctctttccggtcccaagcagcgctgccagcggcggggaaaaaagaggaagatccgtaaaattcatatgcccggcatcggtaaactgaatctctcttccatcctttgccagtgacaaaattacatgattcacatattgatcgccgtatttctgcccctgctcataatgttcggaggtatcgatgcataaaaggggaatcgggtaaggctccgtgttcatctggtattttccgtccgcaaagccgatttcctcgcccagcatagtcccgtccagatcgatgacagcccgcacctgcggccgttcccgtcctgccgtcaccgcagccgccccaccaagggagtgtccgaaaagcccgatattgtcaggatccgttatggaaaaaggaagggacgcaccctcttctccacaaagccttgttatctcatccattacaaagttcaaatcgtctgtccgcagctgaagccaaggcctggtcacccgaaagatttcttcttccggcatgccgtctccatttattctggaaatatcactcataaactgcttatccacaataatcacttccccatcatccagctctgaaaaaatcgcatgatatggatgctccacactgcataccacatatccgttggaggcaagctcggtataggccgaatagttgctcatcctgtacccgaaggcgccatgggaaaacacgatcagcgggaaggtttccccctccccggaaacaggataccaaaactgcaccgccacccgcctggacgaaccgtcggagcagaattcctcctccctcgcatcatctgtccaggtaaagcttaccgtctcgtaagcgtagccgccggttacaggcaaaggtatcacaggcgggaacaaaagggccggtatcatgcagaggaacaaaagcaatagatgaacaggaagggccgacggatggtattttgccgcctttcttattttgccgttcttcttttttccctcagaaaaaaagaagtaagcagatataaggccgcacacaagataaatgcccggaaacagccaggctgtatcaaggggcagcccaccaaatatgacaagcagcaggaaaaacaggatttctgcggtaataaaacccatttgaaccaccggtatgcgcttccttttgccaaaaaagatgccttcctttaccaactccgctataaacaaaattgtcagaaaaaaataactcatgccactccttcattgccgctttctgtccggccgaccgactgatttttaatgtctgctgtcagtatagggcaggaaaagcgtatccgcaatgcgcagggaagcggaatgcagaaatggagcgtgaaatgcatattcctattttaagttggaaggcgccgctttgtaaattacataacatccactgtttctattgccaatgtatccagatgttttagcagcatctcctttgtaatgacgcatagtgccagccaggaggcttttttcttttcatctttctcgcttattatatggttttcatggtaaaatttcgaaaaggccactgctatctggtaagcattttcacagacaatattgggggctttctcatgaaaggcgtttataaaagcgttgccgctgagtgcaatttttaacaataattctctttcactttctgaataaactccctgcagttttacctttccgcagttgatgccggttttcctgaggattgaattgatacgggcaaccgtatatagaagatagacgcctgttttgccctccgatgccataaatttatccgtatcaaaaacgtagtccttggaatagtggttaattaagtcaccgaatttcaccgcggctatccctattttctccgctgcggcttttttgtccgcctctgggatattatctgatgattttaatttttcataggaacaggctgttactgaatccagcagctctgacagctgcattactccgccgtccctggtcttaaacggcttgccgtcttttccgtttaccgttccaaaacacagatgggcaagctccgtgctttctggtatcagcgcagccttccgggcgacacggaatacctgggtaaagtgtaaattctgcctgaaatctacgacataccatattttttccggtctgaaatccgtttcccgctgtattatcgctgcaatatctgtcgtcacgtatccttccgagccgttggatttcacaataatcgcaggcgggaccggagctttgtcattctccttcgccacctccacaacctgtgcgccttcgctttttacaagcaggttccggtccgttaacagctgcaacagctgaggcacatatttactggaatcactttccccataccagtaatcaaaggaaacgtccagtctttgaaaggtttttctgatttcctttacagatacctcaaccatgttacaccatatttttgtataatgcgtatctcctttttgaagccgggccgttatcgttcttgctttttcaagaaagacctcatttgttttacttttccggcttgcggccggatagatttcatttaataaatccgctgtaagcatgggcaatgtatctgcgtatctttcctccagctctgcaaggaccagccccatcggaaggccccaatcccccagatggacatccccaaccgctttcctgccggtcgctgtaatgattctttttaaggcttccccgatgatggctgaacgcaggtggccgacatgcagcggtttggcaacattgggatttccgtaatcaagcactatggtttcctcttgctccgcctgagggatccccttaaatttgtcatggtacatctgttcggcatagtccgcaaggaattcatccttcacgcttatattgagaaagcccggccggaccacttctattttatagatataaatgcagccggttatctgatttgcaacctcttgcgcaatcatcaaaggtgctttcttataccttttcgctccggccagcgcgccgttgcattgaaactggcacaggtcaagtctgtcggaaatgctgaccttaccgagtgtttcatcataaccgcactttgaaaatgcattcataaatactgctgataacagctctgttaataatttcatacttgctcccttctgcgcagcagagcgtgtttggaaactgcccctgcgctttcaaatgcttctgcagcccgccggggcggtaccggactacttccggcataaatactgcacagcttcaattatttagttttcaattgcaataaaaaagcaccgacaggctgtgtgtgcccgacagtgctttgaaaataaatataattcaactcactttctataggcacacagcaaattaagcctgtacctataaagatacaagcttcatcgtctgcgtcgaatggaaagtgagaataattgactcataattcgctcctttgaaagttataatgtctatttatagcatgaattatccggtattgcaattacttttttatacttaagttttttattcacgttttgtaccggaggccagggtctttttacgcaggatatccagcgtatggtggcttgcccctatcagatcctgcctttcacagaccgccagatggtatttcatatagatgccaaattgttcatcgttcatattgtctatgacagggcgcatatatccggttgcgccgtcagtggctgtcaggcagatccgttccgcctgtacagattggttcagttccgcaatatcctctgtccgcaccagtgcaaacagatcctccggctgcgcggtaaaatggaaatcctccgtcagctttcctttctccaggcagtcgtaaatggttccccgggcaaacagttctcccaccacagttggatcattcatgcagtaggcgatatacagaatcccgttttcacgggttacccgtacggcttcctcaagtgctttcttcctttcatcctgcgtataaagatgatacatcggcccgagaagaagggttatgtcaaacgtattctcctgatagcgggacaaatccagggcatctccctgtactgcctgaagtctcatgccatcctccgtttttgaccgcaggatattcaggttgtgttccagaagttccactgcatctacccggaagccttctttcgccaatgcaagggaatagcgcccggttccggctcccacctctaaaatacgcattccctgttccagaaatttatggatgtatttcattgtcgtcagatattccaccaggccgtgctttgcagcagacagacgggcatcttcccggtaactgccgtagtactgcctcaggtaaccatttttatccatatattatcgctcccattttgtatgtaattataatggaactgcgcatggaagtctttatatataatgacaattctgcactgcgttgtctgtcagtcaaataaatctttaagatctgccgccaccggctctacagctctttttcctgcctgtttattttctttcttacgttccgatttccatttccgttcctcatacatatcccggctccagactttaaccggggctttccacatttcctttttattccaaagaaggctctgccgccgcagagcctcttcttatcttatccttatcctgtaaaccgctattacacattaatttccgctttcacgcccagcagttctttattttcctcaagcacaggcccgattacatccttcaggaagctttccacctgtgccggggcacagccaatatatttggaagggtccatggtttcggccagttcttcagcggtagtcataaacatgggttcctgtgcgatgagctccagcaggttattgtctttaccctccgctttcacccgcctgccggcttccatggacagttcccggattttttcatgcagctcctggcggtcgccgccttttttcaccgcatccatcataatattttccgttgccataaaaggcagttcactcataagccgtttttcaatgaccttcggatataccaccaggccgtccaccacattcaggcacagatccaggatgccgtccacagccaggaagccttccggcacgctcagccgcttgttggcggaatcatccagggtacgttcaaaccactgggtcgcagaggtaatcgccggattgagcgcatccgcaatcacatagcgggaaagggacgcaatccgttcactgcgcatgggatttctcttataagccatggccgaggaaccgatctggttcttctcgaaaggttcctccacttccttcagatgctggagaagccggatgtcattggacatcttggtggcgcttgccgcgattcccgccagcacgttgagcactcttgtatctattttacgggaataggtctgcccggataccggatagcaggcctgaaagcccattttttccgcaatcatgggatcaagcgcatttaccttgtccatatcgccgtcaaacagctccaggaaagaggcctgtgttcccgtagttcccttggagccaagcagcttcatagtggaaagcacataatccagatcctccagatccaggtaaaattcctgcatccacagggttgcgcgcttgcctaccgttgtgggctgggccggctggaaatgggtgaatgccagggtgggcagatccttatattttccggcaaaggaagcaagctccgccagcacgttcacaagcttctttttcaccagcttcagcgcttccgtcatcacaatgatatccgtgttgtcacccacatagcaggaggtagcccccagatggataatccccttcgccttcgggcactgcacgccgtaagcataaacatggctcataacatcatggcgcacctctttttcccttgctttggcaacctcatagttgatatcctccgcatgggcctttaattctgcaatctgctcctccgtaatgggaaggcccagctccttttccgtctccgccagggcgatccacagccttctccaggtgcggaatttcatatccggggaaaaaatgtactgcatttccctgctcgcataacgctccgaaagcgggcttacatatctgtccatattatcactcataaacggcaactcctttatactcagattgttccgtcaggacagcctgtcctgaaaccttctgcttttcatttactgaacaattatcctgcacatacccttcccgctgcaaaatgcctgaccttgctgccatgatttccccgggaaagaacagcataactgaaacaagtatatctcaccgcttttcaaaaatcaagaaaacttacacgttcatcacacgcccgatgaactcacggacccgtgcattaggtgaactgaaaagctcctccggcgttccttcctgacaaattacgccctgctccataaagatgatccggtcggaaagctccctggcaaactgcatttcatgagttacaatgatcattgtcatatgctcctgcgccagctgcctgattacctttaacacctccccggtcagttccggatccagcgctgaggtaggttcgtcaaaaaacaggattttcggctgcagggccagcgcccgcgcaatggaaacacgctgctgctgtccgccggaaagctgatagggataagcatcctttttatcggacaggcccagctgggccagcagcttttcggcgcgtgcctccgcttccttcctggaaatgccgtccaccgtcatgggcgcatctatgatatttttcaggacgctgtaatgcgggaacaggttaaagctctggaacaccagtccaaaatgcttatggatccgctttaaatccgccctggaggcatacacacacctgccattttcctcatgagcagccttctcccccagaaaggaaagctccccgccgtccattttttccagcatggtggcgcagcgaagcagcgtagactttcctgagcccgaaggccctatgatggaaaccacctccccttcctttacggtcagggaaatatccttgataacctccagttccccaaagctttttttcatatgatttatttcaagaaaattccggctcattttgttcctttttctcctatccgtgtactctgtgtagaaacggagcccggaaataccggggaaccgcttcccctgcattttcccaggcttcttttgccttaacctctgtaataattcaggcgtttttccacatgctccatcaccatggcaactaccagattgaaaatataataaaatacgccggccgccatcagcggagctacggaggcctgggccgccgctatctgcttggcgatggtaaacatctccgtcacggtaagcgcaaaggccagggaggtatcctttaccagcgttatcatttcatttgtcaccgcagggagcacccgcttaatcacctggggcagaatgatttttacaaaggtctgcgcacggctgtagcccagaattttagccgcctcatattgtcccaccggcatggactcgattccggaacggtaaatctccgcaaagtacgccgcataattcagcacaaaggccaggattaccgccaccatccggtagcccttggatattttcatgccgaacacataataaggcgcaaaatacacaacaatcagctgcagcatcagcggcgttcccctcattaccgatatgtaaattttcgttatgaaacgaagcaccccgattttggacatccttccaaaggataaaaacaatcccagcggcagggagaacaacagggtcaatacaaaaatctccgttgtaatcagcataccccctgcgagctgctgcagcatatttcccaattccatggcttcctccacttatctttctttcgtttgcttcgggctttcccaaattccttaaccggaaaaaagccgctgttgcggctttccttccgaatctctatccgagaatcatcaatatttattcactgacttaccggcggcttcagccagcttctgttattttccaaggcagatgctgtcaagcagtccgtaatctgcgtacttttccgctatctgcttaaaggttccgtcctcagccatctccatcagggtcgcttcaaccgtatttttcagctcctcattgcccttcttaaagccgatgccgtactgctctgtggacaggtattccttatgagcctcgccgtccagaatcacatagccgccgtctctggaggcaatctggtaattggcaacgccgatatcaatggccagggcatcaatggcacccgcttccagatccataaatgccgtattataatccgcatactggttcagcgccgcaaaggtatcggccagcgccttttcatccccttccagggctgccagcgcggaggaatccttctgtactcccactgccttgcctgccagatccgctttcgtttcaattcccgcgtcctcagccactacaaatacctggctgttatccacataaggcacgctgaaggtatactgatcctccctgccgttcattgtaaatccgttccagatgcagtcaatcgctccggaatccagctccatatccttggaatcccagtcaatgggctgctttaccagctcccagccctgacgcttgcatacctcagccgccagatccagatcaaatcccacatactcaccgctctcatccttataaccataaggcgggaattccgcatcgaaaccaacaataaactggcgtccttctccgtccgccgccgcatccgcactctgcgcctgcgtgctgctttcttcctcctgtacgctttccgccgctgtgctttctgccgccgcgttatccgctgccgcactgctctcctgtgccgcgccttcggcctgtccgcttcctgatgtctgtgtaccgccgcagccgatcaggccaaacgccatcacacctgccaacagaattgccgctgcctttttcatagttcttcctcctcatgcaggaatactgtcccacagcatccctttactaatttatcgatttagcatactaaatcatcactggcaatatcctatcatgaggtgatttcctgtgtcaagactgaatgtgatttttaatgtgatattttattgaagaaacaacatcccggatggcagatagagcataatgacttttatgcatcaagctctgcagacagcaatcagattctgtcaagcttctccttgatcttccgttttatcctgaaaaatatgcgtgacgaatactgctcgttttccaccagcaattcgtacgcttccataacaccggcagagtacacaaacccgaagatgcctgccgcaaatccaaggaaaacaaaggaatgaaaatccgaccatgcaatatatcccctcgctgtaaagcccagaaccaaaacgccgataataaacagcaccgtacagggaatggccacggccacatatctcttttttcggaaagcatactccttcgataattccttcaggtattcataatcaaataacaatggttcctgctttaaaatcttatattttgcttcctctgaaaacattgcgaataccaccgaaataattcccgccacaacgcacagcgccattccaagcagccgccatgttgtccctgccggaaacattacataagggataccggccaatgcccagaacataaagcctgttcctacataccggctgacttttttctcactgataatatatgcctccgccatttccctgctcacataatatcccttttcgtcagcactcttttctgtttttgcatcctttaataagaaatctgttgaaacctcaaagatattagataattgcaaaagcttttctgtttccggaaatccctgattattttcccatttactgacagcctgtctggttgttccgatttgttctgccaaagcctcctgagacaatcctttttctttccttagcttaaaaatcttttcacctaaattcattgcatgtatacctcctgtgatttgatagcaatatgctgccagatcgcgctgccattttccatatttcagggaatgcactttgtcaatttcaggttgcatctatgtaatccgatgaaaaaaagtttgcttttacttctgtattcactttttcggaagcctttccagcttatggaagcctctcatataccggcacacatatttataggtttccaaaaccgcccgtctgcgggcatccttacccacctgtccgctggttttgtaaaaaagctgcgtattgcagtataacagcttcatgggatccttcaggctgttttctattgtaaaatcccctttctcctggaactgcctgatataaggctctccctgttccaggcatctggtaaggcgctcatagccgttttcttcctgaccggacagcagctcccatacaccgaacagatactcgtcggctccccatggatgcggccttgcggcatcggccctgtcgtcccacaacaggcattccctgattggatccggcggccctgccagcatcgcctgaaataacgcctggcgttcaggcgcgaaaaaggcctccaggcagtcaatctgttcccagcaggggaatacctcttcggcaagaaaggtaagaatctggtcaaatttccggttgatgccctccgtatctgtcccgttcaaatcaaattgtatgacaccccatccggagagcatttccttacggcgttccccgtgcatgacatcccccggcagattgaggatatggctgcggatgtcgtagagcgggcagatacaataatctatcgcctcgtacccgcctcccctgaaatatcccacaaaattcagataggagacgataccgttctgctcctttacaaaggttttggggcctgcttttttcatgccgtatgccctggcaagaggggcaatttttgcctgcatattttccttcaggcgaaggtgcatgaggcttttgttttccttctggctatcctgcggtaaaattgggctggcgctctggggtggggccggaacctgatgaggcagggccggaatttgaccggatggatcaggaacctgcgcagacggatccggagcctgtcccggcggcgtccccagcctcttttgccagtcgaaagccaccggcgccacgggatgctttgcaagaaaggcctcccaggcatccataacaggtgaaatcctctcataataatcctgcaggcgtttctcctgccgccgtttgaattcctcttccgcctttattttgtaatagtcagagctgttttccacaggatgtccctgcctgtaaaaatagtacagaaccccttcctggctgcggcacatggaggcgtaatccaccggcctgccgggtttgatacgcaggaaataaccgggggaaaggtgagctttcagctgctccgcatgagcatcccaccaggcttcccacagggcaggctccaccgctccctgcacggcctgaagaaacatattttccatttcattgataaaatccatagtccataacctcccaatgcctgtatatggcgcggtaccgcataaccctttgcggcatgatgcctattaccccagctgccatgccaggatttttccttttaccctgccaaacgcgaaaaaacacacgcctcttcgtttatcataaccatccttcttccggcatctgaaaccgcaattactcccgccacctcttcttccttaacgaggaccgaaaataaatcccactgcatgcagggcataaaaaggcggcataaaacctcaggattctttgaaattccacagaacaacgaatagaaacaatcccatacgtattaaaaatctgtatttaaaacggcctttctcaaagatacctttctatcctgccttgctccacaacacgttttcccaataaggtaatgcactgttgcgggcaacggctgatacagcgatagcacatagtacaccgctcgcctgacttggcgtttccatccactaaggttatatttctcatggggcataccgccgcacattgcccgcagccaatacaccttgaactgtctattttcaatttatccgtataacgctttgtccggttataaaaataaagtctttggccaaacaaccctgccagatggcaaaaagggccgataccgtcctgtggcggcgttcctttctgcgtattacgtgcggcttcagcagatttaggcttcaactttttttatccagaaaacctataacagaaaaaacaagtccaatcatcccaattataagagttacccactccattccagatgaacagcaattaaatacaagggcaaataataatatagctattcctaaaccaatttttttcatttcaaaattctcctttgctccttctaacctgtcaactgtaaaagaattgtacagcgttccggctttcacagggaatgcgagtctggtatccgtcaatatacctgatgagctccattgccgcatttagttatacctgtactgttttctaatgcttagttctggcccatatggcgtatattcccatatgactgacaaagcctgcctgcacccggttcgtttcgcagcacctgtctctccaacttattctaatcgagaataagttcgaaatatggctcatccacaaagcctgtatcttcatactgcctgaacccacattgaacaaggccgcatttctttgtcatgtttaatgaagcctgattgtcagggtgaactgaagcgtatatatatatagcctttttgccggccctgagccattcaacgtatgctttcaaagcttcagtaccataaccctgatgctggtattctcctgcaaggtgaataatgagctcaacatgaagcgggtcctcctcgtcaggctctcctccacaaatacccaaaagcctatcattttttattactgcaaaaatcgcattgccatacgtgttatactgcccccggttgtattctataatctcaggaatctgctttcttgcaattgcgcccccacagaaacgcattgtctctgtgttgccccaaactttgttgaaaagttcatccaaatccccctgttcaagtaaccgaaagcctaacctttctgattcaaatatcattgttttcacctgtaaattcaaatctaaatcagtctctttaattttaattcataagaatgcccttcctattctgaacatttcagccctgctcttttttccaatgctatcggaaaaaattcacgtataattggatacgttaagttatcaggcagagaatcaaagagtccgatcttccccatttcactgtagtccggcaaatcgcccaaagtatggataactgcaaaatatacctgtccattccctttatagtgatagccattcaattccgcatctatgtaataatcgcagagcggctcaatatcaaaattaaccgccccggtttcttcaaataattctctttttgcggcctccatgggtgtctcgccattttctatccaaccgctgggatgctcccacgtattccgctgtttatgcatgcaaaacacccatttccccctatatatcgccataatatctgcggaaaaataattttcaagtgtattaaaaggacgggcataacattccataaaaacacctcactgtttttgtattgctctccatcagagcttttctgtttactgccgtctgtctctttaccttcttcgtgaaactgtacaaacagctttttctccacaacctgtaatttatattattgtgccagtttcttcagtctgtcaccggtaagtctatacacgtccaatcagacatcggctctgcatcaagtgataaataaaaatctatgcttggtttattccaatcgagacagctccattccaaccggccgcacttacgctcgacggcaatttccgcaagtttttttagaatggcttttccatatccttttcctctatactccggtaaaacaaataaatcctccagatacaagcctgccctgcctaaaaaggtagaaaaattatgaaaaaataaagcaaagccgacttccttgccgtcagcaaccgcaaatattacttctgctttttgcctgtcaaaaatccattcctccagcataatttcatctgcgattacctcatccagcatcttttcatatacagccagttcttttataaatctcaatatcagcgaaacatcttttcgctgcgcatatctgaactttaatcccacactcataattttatattctctccggtaaattctaatttatataatagatactatgtaaacaatgcttgcagatagcagagaaatcacacttcccaacacaattccctttatgccgcctttaacatggaataaataattcttatattccttatccatatcttcggttccagctattcttaattttttactatggcagaatacaccaatatcaagcacaattacatcaaagagattgacggcaaggaataagataaacacatgtgaaaatgctgtttcaaatttcttagctcctgaaaaataggcgactgctgccaaaagagtaatgcacacaaatacagcaatgagtttcttcaatatatgtactttttcagtacttttaacagtatttttatattctggcaaagattccaccctttttctgatttctggaggatacgacataatatacttgattgggtttttatattgtgttggcagtataatcaatgcaaaaattatacaagcaatcatacattctattgctaaaagcatagttattctcctttacaaactcagtttgtttcgctttataagccaggagttatacgtcacttgtactttcgataaaaagagagagaaatcaatattcaaaagatactgcacctatggacatctcatcttttataatccaatacatagagaaaactcggtaaatcagatttttaaacgtcttaaggtaataaacattttttgcagaatttctgtaattctgtttctttagcatatacatcttctttatattctatggaacataaaccaatgctgccaagcggttttatctcaaggtgtccataaaaatgttctatacttccaattattttttcacattcacccatacctggtccagtcctcagtgcaatcacataaccatgcttaccttccggtatggttgcatgaggttcatgtgtattacaccacggtgtacatctatcaatgaaaactttaaactggccgggtatatcagcccaataggatggagaaacagatataattttgtcagcccattcatactctgaaatcaattttgtcgtatcatcttttaatatacatcgcgcagtctgatgacaagtcctgcaccctttacagaactgtatattataatcatctatgcaaatactttttacttcattttccttttccatatatgaactaacaatatttacgatttcagctgtagccccattacgaacaggactgcaatttataactaatattttcactccaaacctccgcaactatcaatttgtcttggccttctcctccgagagcgtctttaccaataaagcaaaattatcacccgacttttagatgtattctggtgaagattaaatattaatcgtacaaaacctgtattttcccttttgttcataggcttttgcatatttccctggtgaaaaccatgaaagttaacacccagattttaaatattcataacactgcacgaaatcttttcattcctattaaaagctgacttctaatatctattgccagttacacattccccaccaggcatatcctttttcagctatttcagctcaagataccagtatctctttgggttggtgctattcaggataatctctataatacttctgaaatgtcagttcatcaaacagttttcccgttacaaatatttatcatatttcccttggggaaaaggactctccaaccccaaaacccttggccacagacccgtatcatcaataacaaatcccatgatcatccccatatgagtgtgtaaatgtctgaactgcgctaaaatcaacgtgaatttgcaatactcacaatctacaggatattctaataattgttcatctgttaaatctgaaacatattcttttattttgtcttcaatacggttaaaataacagagtaattgctcccgcgaaagttttttgaaagactccatatctaagttgtttagatttgcttcatgtatgtcaggctcttggaaattcttatcccttggattgatataccataaatccaacgagtgcagcatatgatatatatgcttaaaacacggcatctcacaatattccttattccataattgatcagggacacaatctattaaattccttacttcccacagcgctctgcctgtctgctcttcaattatttcaacaagcgtattctgtttcattccttccccttctccctgttcaaatttatcaagtatgccttctctatcatgaatgcaaggaataactttctattgactctattctctgtaaatatttttcccgaaatcgtaggcttccctaaggtggttcgttttatcaatctgcggttttccattcgtatctccgcaccctccggcaagcagcatccctttatcatggaaaccaatataattgataagcgtaaatttgtaataggataccgcctgttcatatgtccagaaaaaatcatcagctgatgtcataagtaacgcggcatctttgaccggatacctttcataccgccctttttatttattcaggtatcggttcgaattccttcaagtcatcatcggtaatttcccggattaccttacaggggctgcctgcggcaaagcacatcgggggaatgtctcttgttacaacacttccggcgccaattaccgatcccttaccaacagtcacaccggcacagataacaacattgcttccaatccatacgttatcctcaattaccactcttttacagtacatttccccacggctgcgcgccatatagtgcattggatgatttgtggtgctcattgtaacattgggcgcaataagaaccttttcccctatgatgatttcataatcatcaaccaatgtaagattggaattaatatacgtgccgttcccaatcgaaacggtttttcccatcgccagtgtaagcggaggttctatccacacattatctccgcaaaaagccagcaatttctttaaaatttcctctcttttttcagtttccgttgctctcgtctgattgaaatcctggcaaaggcccctggcgtatatttgctgattcatgttttcgccagtatcaacccataataagccttccgcccttcgctcagccattgacagtgtaacaacatcttttttcttcattagtacttcctccacttttattgtccggtcttataaaccggcagtatcctgcgagatccgtttcagccgcttcttttccaagaaccaacctaacattttcccaaccagttctgattttgattctgattaaagtaattatactgtggattccccataagggcaatctttatatacgcaggccgcacagaattaataaaaagatgaaaaaagcgccaatcattattgactgacgctcaggactgttaaatataaaattagcaaagcaagctgttccgccataccgggacctggcaattacactttttaccaggcaggcataatattcatctaaccatctatcagaccaaaagcaaggcctgcacccaaaacaaatgaaggcatcctctgaaaatgtcattatccagcatttccattcccctctcaggccctgtttatgtgttttatctgcctgaaacacgcaaaaataaatgtgaatatatcaaacttctcttatcggaaaatacatatagtttattcccacaatactcccgtttgcgtctttctttgccaatgacaacaaatctttctttatcaccttaaacattgtattcctcttccgtaaattcaaattcgaagaaatacatcagttatcggaaacccttattaaatttctatcaatatagcttttcactgcaagatcaattgtttccaggcaagtatatttaggctgatattctaaaagccgctttgttttttcaatactaaatacaccacttcgcacaatatgataatatgtatgttcacattcttcggaatttccttcatacttgcaccattccggccatggaagaaacttaattttaggttcatgacaaaaatactcatacatatgttttgcaaaaccatataatgttatatgtgtagcagcttcggcatcaaaagcctctccaagtgcttggtttctatgagtaattgctttgtaaaatacctgtgcaacatcataaccatgaacatgatgcaggatttcctgtccaaagtttggaagtgctatttcttttccatcagcaatatcctgaaatactctcattgaagtatttccccatggattaataatcgcccaaccaggtcctgatatctgtccaggcatgataattgtagatggaaagccctccttttgatactgttccttcaagtacatctcactggcaaacttgtcttttccgtattcatccaatggttcttttctcaaatcatcaggattaaacggtattgtttctgccattccatgcgcccagcaagatgagcaataaagataatgaaacaatcctgtcccaccgaatccttcgacaatcttcttggtttccttaatattgaagtttaccaaatccacaataatatccggttccatagcctttagtttttcaatgaattccgaatcattctctctatccaataagacacgtctcaccttatgccacgcaggtgcatcttcataaggcattgacatttttctggtaatcgctattgtttcatatccgttatctacaagcataggtataagataagtgccaatatgtcctgctgcaccaattactactacacgcattttattttcctccataaattcaaacttttcagttcgacaaactgaaatatttatgtatccatattttcccataagccatatcttctcgttagacacaataaacatatccttctgaaatccactctgggaatatatctttttgccgggggtgccatccgtcatgttttgaaaatcccgtttggtaagccagcgaagaaattgacgcttcctttcgagttggaacaagagcgaatacgctacggggtctgatcgctgcggagggctttatataccttattttccgaaacataattcacaatcatttctactgccttatcaatacctatggaagaatccaaaacaagctgatagtttttcccatcatcccagcgctttccggaaatatggcgatagtaggcacttctggctttgtctgaacggtggatattccacctggcttcctcgggtgtgtcaccataaatttccataacccgcctgatacgatatttcttcggtgcatggataaatacacgaaccacattgtcataatcccgaagcacatagcctgcggctctgccaacgatcacacagctgccattgtctgcgatctggcaaatgattttcttctgagcatctatagcgtggctgactgcaccggtgctcagatacaggtcacgaagcacctcgggagaattcttgtgaatatcagaaataaactccgcatccagtccgctttcgtgggcagccaatgcgatcatctctttgtaatagaacggaatgtccaggcactgcgccaccagcttgccaatctgcttgccagaggaaccgtgctgtcttgctatggtgataataacgcccggtttggatggctgtaatgcaggagctgcaccggaaacgggaatctcaggtcttctgtttttgacgtagtccgcctccagaaactgacgatagaacacgatgcccgcaatacttgtgatgatttccgttaccaggaaggtcatccagaaccatgtaagaccaaagcgggaaaatacatatcccaaaggtacaaacagtaccactgtacggataacggtcaaggctgtgcttttcaagctatagcccacagcctgaaagaataccggaaaaatcagagaagtgaccatgggcaggaagctgatgccgacgaagcggaaaccgatgcacccaatctcgattacaagagggtctgatgtgaatacactgagcatcggtccgggaatggaagcaaagcacagcgttcctattgtcatcattacaagaccgaaaccaatcgcagtcatcaatgtttttttgcaacggtcaatgtttctggcggcatagttaaagctgatgatcggtacgatacaggtctgcatggcattcagcggaataaagaaaaacgtctgccacttatagtaaagtcccagcgcagtaacagcctgatcagagaagcccgccaggataagattcaggccaaggatataaaaggtatacgcagactgcatgaggatgttgggcattcccaaatggaagatccttgcaatgtatcgggggtaaaccgcttttgcaggtgaagggcgataacccttcttcataacaatcagtgcggcaacgatctgtcctgcaacggtggcaacagcagctccggcaatgcccattcggggcagtccaaacataccaaaaatcagcaaggggtctaaaataatattcgtcacagcaccgacgatctgcgcaaccatcggagttttcatatcgccgttggcctgcagaacctttgtccagatactttctaaaaacaggccgaagctgaacaggcagacgatcctgccgtaagtgattacatcctgaatgatcgtttcggattcggtggacatcctggcataagcgggcataatgagccagcagatcagtgcaaacaaaaaccaaaggactgtggccaacggagtacccacaccagcgtattcattggcttccttttcccggccttcaccaagcttagcggcaatgatggtgttgatcccaacacctgttcccactgcaagagcgatcatcaaaagctgaagcggatatacgatggacagagccgttaaaccatcatcggaaaatcttccgatgaaaaggctgtcaataatgttatacagcgcctgaatgagctgtgcaagcattacaggcggagccaatttcagaagtattttactgattttttcttttccgtaaaatgcaatcgtatccatttattcctgttgctcctccataacggtacataatgccttattataatccgataaaagccctgtcagcatggccagcctttcatcgccgagcagttccagcgccccggtttccattccttccagcgaagccagcaatggcgcgatatagccggtacccttttccgacagaacgaatgccttttcacgcccaatagagtgcacactgctgtattccagcagaccgtcctttcgcattctggtaatgacattgttcattgtctggcgtggaagtaaatagctgtcgcagatttgtttttgggtacagaacccgaactctctgatggtatagagcacgagcatctcatgatagctgatcccatgccgggcagaccactcagagtagatcccacgggctttgatgatcgcccggttaatgtcgttgacaactttcagtgactctttgttcatgtgtacctccttcaatataatcccaaatgggattataccacgagtcagagttttttcaatgggtttcacggaaatgttacaaaaaaatgcccgcaggatttctcatacgggcatttttaatcagctatccaatgttttatatccagttacagtttgcaaatatatctcgggattgccattcaagataaggtcagaatattcaagaggtgcattacagatcagataatcaagttccgctcgttttgatacgcacataccttaggtctccgtctatttcagccgttcctgactgtgcccaaatcatagcccctgctatggttgcaaaccacctacaaagcacactcaatttgacaacttatagttgtacatcccggaaatatggggttttaaggtaattctcattaagctctatagcttccgcatcatcgtatacaaaaaccagcttctttgaattagtcccacacaatttccaatcgtcctcccctcactgcactacgtaatcccgatactcctcctccagttttcccagaacgccctccatcagctccccgcacttttcttcctctcccgagaagaaagcgctcttaatctcagctaccacagactcattcctggaagccgtccagccctccttgcgttccaccacaagcttttccagctccagggacgcctcataatactccggatgctctgtcaggaaattcagatactcctgctccttcagatgcagccgcatcgccgccagataggaaagcaggctggcgggatctcctcccagacggctggcctgctcaaaggacacagccgctttttcaaataagaacagcttggcctgcgcgcagcccatattatggtaaaccttccccaggaaaacaggggacagtccctcgccgtcatgaagcagcttctggtattcctgcagcgccagcacatagcgcctgctttccaggaaataatccgccctggccttctgcttctctgacagtgtcacatctgcgctcacctccaccagatgctgtgtttcccggatttcccggtcgtcaaaataccctgtatactcaaaaattacggtaacaaagctttccggtttctccttattttttaaaagcatattcagcttctgtcccagatccggcagggcgcattccttccctatccagtcaaaaagccccctggtaaaaatattttcatccagcagatacgcattttcccgcaggaagaagcacagctcctctatggaaaaaacacggaccctggacttttcaaaggtgtatggattatctgccagtcttcccagacataaatggaccctgctcatgcgcctccgcctcctttcgctgaaatatgttaaaatcgctcctgccgtcctccaaggctgaacgtctcctcccatatcttatgggatgccgggaacatttccccaaagcccagatcctccatccgcagctttactgtatccacatcctccagagaaaccgtcaggcgtatcctcgtcgttctcacaggcctctccggaaccccgtccagcgttacggtcacttcctttacctcacgcccggaaagaggcgtaatccgcagggaaaacgcatgatcctcgttcaaaaggaaatcacattccctttttgcatcataccagttggttcccgcatccagcagtgcaaaataggattcctcccccctgaaggccgcctccagcccgatattggccttcagcatgtccttgcccagataaacgtagccgctgctgttttcaccaggctgctgcttggcccttgccccatagcacgcccccttgctgtacaggttgtttcccaggaaaacacgcctgccgcggcagaggatcggcagcgaacgggtataccagtcaccttcaaaaccgtcgcctatcagataaaccgtatcaatgatttttccctcgcacacctttcctaaaatcgccgcaaagacgctgtccatccgctgttttacagcctcccgttcagcttcctcctccggcagggcctctcttggcagctgcgggtaatcatcctcccgtatcatcaccgtcactggcctggtatgccggtttacctcaaacatgagcagcttcatatggctgcccgaaaaatcgcataccatcacatgatgccgccaaagctcctccggctggttgatattataatagaagaagctctccgccctgctttggcaggaaacccgttccggcggcagggaaatcagcgccgccacccgggacagcacctccacggtctgcttatccactttttccaacgtaaaaaggaacatgcccgctttttccggattgaccgcccccgcaagcaacgaaaggcttcgtttgataaacagggaaagcaaaacagccccttcgtagctttccccgtccacctccacgctctcgcccgccagcgctttggaaagcaagttttccacaaggatgccgtcaccggcagccgcatttttcagcgcttcccttccataggtccatacatcccgatccgtgcgccggcagagcaccgcgggaatcatgtactgctcctcgcccatgacctgagtcagtgtttccggtttatccgctcccggcatccagaagctgatctgggcaaacctgtcgctgatgtcatatccgataaacgcgcctgttccgcttttcctgtccccatttcccagaaacatcttccttcacctgcctttcttctgcggcagtccagttaaaattgaaccacggtaacggccccgatgggctgaaccgttacaaaccgccgcttttttttctgttactgcccttttatctgaaacagtccgtcagtcatccactccgtcatcagatactgttctagaagctcctgtgcctccgcttcctctcccatcaggcgggcggaagcgatatcgttaatcaagccataccggctttccttcacaaaaaggctgcagtcccccattttcagctcgccgctgtccaggatctccccgctgccggaattatccgtgataaaatactgcaggctttctcctgcaaacaacacaaaactggccgtataaatgcccgcatacatatgctgcaactccagggtccgataagtcttctgagacgcagaaggctcgctgccgcccgttccatttgaaactatccggtaattgatcactgccggccgctccctttggccccggaaaactaccatggttttatccatcatgggttccgcgccttccaggatatccacatactcctggaacagaggaagcttcatattcttgctgataagctcctccccgaactgcttaatcagcaaatcaaccctttcgccgcgctcgtcacggtttctcgcaaaatattccagaaacgccaggcggcacatatcgcttaaaggctcacccctggccgccaccctgccgatatcagtgatgatgtagcggtccattttttccccgttcatcagatacagaccgctgcacctgtgcaggaaagccgcttccagctcattttttccgccgcccacaatatactgccgtaaaagcccggtgcgttccagcacatttacgccggtatagagcagctgcaccagcagcctttccgtcaggttataggtgtccaccgcaaagttctccgcagccctccggatttccgtcagttccttacagcttccctcatattgctctaccaggtgctgcaggatatggctgtcatatttttcccggccgaatgcgctgtagcaaagccgggtcatggccgcttcctgggtgcacaggccggtttccagcattctgctgcacaggcgcagcaggattttggcatccgcacgtcccagctccattccctgcagccaggcgtaggccttttcataaaaagaacggagcaccagaaagcctgccgcctcataaacatccgacgcgtccaaatcctcttttttcagtgtctccagcagcagatccagctcctccaggttctcctgtccataataaaaacgcagcagcgccatgcgtatcgccctggcaaaggccgggataacatgctcatcctccgcaagcagccggaacctggacgcatttttttccgtaatccgtatttttcccttgctgctctcacagcagaacagattaaagcccagggaattttccacaaagggctccaaagcgcccgcgcaccgggccggatacatcagccggtcgagtacaaagggccttccggcggcataacggttatgggcttcatcctccagaaggatctcataatccttatcataaaccgccacataggctctgccatcctccaccggataggcctgctcgccccgcagccgggtatggatgaccaccgcctgccggatatccgctccctcacagtccagctgctgtatgaaaagaaggggcgccaccgcctgacagttatccctggtcagcattttttcatccaggacggtctgatacagatacgccagatgccggttgatgcggcctttatagagctgctgcagcacgaagcggtctatctggctcttgtaggccaggtacagctccgggaactcttccctgtgcttttgcagataggcatacaggtaggcgcagtgttcataatccagattgctctggtaagcaaaatacatgagtacaatgcgggggatttccacttccttattcaaatccaccgacatcatataatattcatacagcctggtaaccctcagctcctgctccacgcccctgcggtaccacaggtaatattccgggccgcttttatttcccttaatgagcagggaacagatggcggcaagcagctgcggatcactttttttctcatagcaggccttcaaaatcccgaacaggcactccttataatatttttcctttcctgcaagatagaccagatgccccaccagatcctcggaaaggattccgttcctggcgccgaaatgcagaagctgcagttcataggtatccagcttcatcatcagggttgggctgaaattcgccaggtgcagagcctccagatacagcacggggctcgtcccgctgcgccggaactgttcctccagaaacagccatttctgggaaacgcttctccccaggggtgccagcataaacagcagaagccaggcaatccgccagttatcccggtatacccggtaaaaatcctccacctgtatggtaacctctgcggtaaaagcctcatccctgtgatacaggctgctcagatacagataataacagtaaagctccggcgcttcatcgtccagggtgatatccagatgttccagaatccgtcccgcatcgtcaaagcgttcctccgtaatcagaagatgcgcctgataaagccgcaccgcaggattcttatcatccagccgcttcatccgctccaccacctcagcggtctgcgccctccacagcactgcattcatccgcttcattttataatcctgataaagccgaaccagctccaccgtcagacgcttcatctcctgccggcgcccggttctcgccacacgatgctccgcccttttgataatggtaacggatgcatactgtgttccataggcatgtcttaaaatgatccttccgaaattctttccttcatgcagcgcctcctgattgacaaacaaaggcaggctgcactggtttcccaggaaatcctcctcccgcaggatttttttctccgcggaaagaaaacctccttccgtttccacctccagataggtacagccccagccgttttttacaatctgaagcgtctctcctccctgtccctgaaggtttgccaccacgatttccgtccgtggaagcacatattccaccggctgcttcttatgcacggaaatgagaaattcctccacgttatgcacatttcccggatctctggaaagacctttgtacagatttcggtatttccggtcctgcccgcccagaacccgcaggaaatcaggtgaataaaacagcttcacagcctcctcccagctatttctcgccaggttcgtaaactggaacagattgcccagctcgccctccgagctgaccagctccttatgtaccaccaccgcctgaaacggcacctcatactcaccccggttggacacgatcaggaatcttcccctgcgctcctccccctcccgcatcccgcggctgtcaaaccggtactctatattttccacagagcccgaaaaaaaagaagtcaggcactccatacgctcttcgtcacaggaaacgtacccttccgtcacctgtccgggttccccggttaccgtaaagaagccttccctcacttcatccttttccagggccagacccacttcctgacatgagagctccaaggaaccgcctgtttcttcccaatcttctgttgatatccgcgcaaaaagctccttcaaagttctcacctcctcatctgtttttattcaactatagctaaaacacgttgcatagacctgtatatattcttatagtataacgccacagtgtttcataaaaaaattgtaactgttcagtacccctcacagttactgctaaaaaccatcctaaatcgcctttggcgatggattttagcactcttgaatcactttcttacggtcaacgcaaagcgttgacctgcgcagctaaatgcgctgacctgctgaacagttacaaaaaatttttctttagtctgtctcttcaattcagcccattacgccgttcaatttagcataaatataggtatctttccaaagaggcctattttcgtcatctttccagaaataaacattttgtcttaaatgtgcttctctctcaaaacccaatgcctctaacaatttccaggaacttgggttttcaggatcgcactcagcaaagattctatgtataccctgtgaaaatgcctgtcccactaaagccagacagctttcctttgcataaccttttccccaataatcctggttaaatacatatcctatttcaagcgactcaaaatccctatttcccagatacacatttcctatcattttatggctttcctttaattcaacagcagtcatttcatctgttgaaatcctccattcaagattatgccttacttcatccatgctcataggcctgtaaggttcaaattttaccacctccggatttgataaatattcgtacaaatcctgtaaatcactttccctgtaccttcttaaaatcaatctatctgtttctgcgattacagttatcccttccaaaagtttttctccttaaatcttttatgcccctgctgctttttacatttcaatccacgaggctgtataagccaggtcttgctctataaacagtaaataaatacaactaatatatcctttcggcatttactaacagccaacataaagctattcaatagacatacttgtttttcaaaccaaaaagatttaatatcagtatacagtataacattaccaataggaatcctgcaacatttcaaaatagaagttcgcggacattatttcatttcatacattcggatgttccgccgcggcatagtcatgggctgaagcgtgccgccccgcaaagcgctgagcggagtaccataccggccgctgccctgttctgtactccggagggccggccggggatttcctctgcggatgccgccgttggggaatttgctgatgcttatgaagttttggtgctgtttcttaaagctccgggaggaggcttagcctgaaacacggcagctgtctgaggagcctgcgacgagtttctgccgtatcagggctgcaaagcttccttccgaagcttttagaaactgcccaaaactgagtagcatcagcgaatccccaatggcggcacccgcagaggaaatccccggccggccctccggagtacagaacagggcagcggccggtatggtactccgttcagcgctttgcggggcggcgcgcttcagcccatgactatgccgcggcggtctccccaatatataaaataatgttcccgaaaaaggagggtattatggctgcttttcatggtagtgatttggaaaaaatagaacagatttacgggataaaaaaggaagagattacgggatttggggcaaatgttaatccgctgggtctctcgcctttcatgaaagattatctggccgctcatttggatgtgctgtgtgcttatcctgaccggaactatacggcgctccggcgggcgatagctgactataccggcgcggatgcggaaaatattatggtgggaaacggctccacagagcttatctctgccgcaatacaggccatacatcctcatgccgcagtcgtactcgggcctgcttattccgagtatgagcgtgagctgaccctggcgggaagtgtgcttcactattatgatctgtgtgcggaaaaggatttcgtcctggatgtggaggatctggaacgctttattatggaacatgccgatggtgccaaggctgccggagggaagctgcgcctgcccgggctgcttgtgctgtgcaatccgaacaatccaacctccagcgctgttccggcctcgcagatgcgcctccttctttctttttgccaggaaaataatattttcgtcatgacagacgaaacctatgccgaatttgcaccctccgtatcggaaatcacttccattcccctggccggagagtatgacaacctcctggtgctgcggggtgtttctaaattctggtccgctcccgggcttcgtctgggctatgccgtcacctccaacgggaaactgcgcggcaggattgatgccgccaaaaatccctggaccgtcagttccctggcggatgccgccgggcaaatcatgttcactgataaggaatacattgaacgcacccgttcccttatcggtaaggaacgtgaacgctgtatccagactctggccgcgattcctgagcttaaggtttacccggcctatgccaactttgtcctggcccgcagcctcaatccggaaataacggcccggactctcttcgaggccgctatccgccgtaaaatgatgattcgggactgctccgactttcatagccttaacgacagctatttccgtttttgcttcatgctgccggaggataatacacggctgcttacctgtatccgggagttgttcgcgtaaccgaagccctgctgcaggcaacgaaataacaaggtaacggttcagccaggcctgctgccctgccggacggtgggattttgctgtcccacaaagcggtggtattttataggcctgcagagtgcagggttttacagtcctgcagaacagtggtatttatcattgacagccgcaggatactgcaatagaataaaaacagaaataataatgaaaaaaggtgatgtgaatccggcatatcggatgctgtataaccggcagcatggatatggctggagaagagcggataaaatcaattcaacaggaaacgaagggctgttttaacagcttatttttcgtgcctggcatttgattttatttactcttcaactaacacttcagcttttgagggcttagccgcagagtaaaatctgcggctttttctgtttatgaaaggagcagtaaaatgaacaacaaaattatcgaagccttgaaaaaaccagcggtctatacaccgtcaggcaccgccttctgggatgatgattacatctccggacaaatgcttaaggcacatctggatccggattttgagggtgccagcaggaagctttcatttattgaaaaatcagcggcatggctcagcggtcttgtaccgccgtctgattatccacagcttcttgatatcggctgcggccccggcatttatgctgaaaaatttgcccgggcaggctatcaggttactggcgtggatttttccagacgttccatcgactatgccagacagtccgcccggagccagggcctggatatttcttatctctatcagaattatctggagatggagctgccgcagtcattcgattttgccgttatgatctattgcgattatggcgcgctgtccgctgacagcaggaaaaatatcatggaccgggtttaccggcagctgaagccgggcggctgcttcgtgctggatgtattttccatggccgcctaccatcatttccgggaacggcagacctgggagctttgccaaagcggcggcttctggcgtcccggcgaatatgccgctttccagggttattataaataccccgaaaatgtaaccctggatctgacagccgtcgtttccggtaaggaggtcactccctattacctgtggaacacttattttactgtggaaagtctggccggagaggccgaaaatgcaggctttaaggttcacggtgtcttcggggatattgccggcgcacccttttgcagggaaaacgataccctttccatatttttaaaaaagtaaagaattctattgacattctatatttattgttatattgtattattaaattaatacagagatacacattaagaaaggaatgatgatatggcatggaacctggattctgaccgccccatctatgcacagctgctggaacgcatccaactgcagattgtttccggcacctatggaccgggtgataaacttcccagtgtcagggaactggccgctgaagccagcgtaaatcccaacacgatgcagaaggcctttgcggagctggagcgcagcggcctgattgtaacaaaacgtaccagcggcagattcgtaacggaggacaaagacatgattacacagattcggactcagctggcaaaagaagaagcattatcctttatcgagaaaatgaaagaactgggttttgaaaaaaatgatatcctggcactgctctcagccgttgctgaagagcctgccgaacaaaggagggagcgcgcatgaacgatcttgtgactatttccggcctttccaaggcttatggtcattttatggcgctgaacaacctgaatctgaatattcccagaggacgcattatcggcctcctcggtccgaacggaagcggcaagaccacgctgattaaactgctcaatggtcttcttaccccttcctccggccagatcctgattgacggaaaggctcccggcgtggagaccaagaaaaaagtttcctatcttccggaacgcacctatcttaccagcagtcggaccgtaatagatttggtggaatattttgaagacttctacgataatttcaacagggaaaaagccatgtccatgctggagagcctgcagatcaacctgaactcacgcctgaaaaccctttccaagggcaccaaggaaaaggttcagctggtgctggttatgagcagggaagccgatctttacatcctggatgaaccgatagcgggtgtggatcctgccgcccgtgatttcatcctgaaaacaatcatcggcaactataacgaaaatgcatccatcctgctttccacccatcttatatccgatatcgaggccgtgctggacgacgtgattttcatcagggacggacagattatgctctgctcttccgtggaaaatatccgggaaacctatggaaaatccgtggacagttatttcagggaggtgtttgcatgctgacgaaattactgaaacatgaatggaaggaaacctggcgcatccccgctttatgctgtgccattgtcatactgatgacccttacggccgtcatctgttttaccaggatgagccctcccgccaaggcagatgagctgaatgcaggcgcttttgtattgatgatgttctatgtaatgaccatcacctgtatcagctttgtcctcacgctttatgtagcggtccgtttttacaggaatctgtataccgatcaaggctatcttatgcatacactgcctgtaacccccaggcagctgctggtttccaagcttttagtaagcactgtgtggctgttcatagttactctgctggtgctctgggcaattttcatgatactcatttttgccctgccggttatggtattggaggatatgaatctgtccttttccttctttatgaaatatgccgctgaatattccgacgcgctgttcgggatgtcgctgccggcgtttatcgtatttaactttttttattttcttgtttcatcaatgagcagcgctttggttatttatggttccatatcccttggccagatgttttcaaagcataaggtgatgggctctgtcctgtgttacattggcgttaccattttaatccagacggttacctccttcgctatgacgccctatctgactaaaatagtcataacgaaccgttccgtttccatcggccccgggatcccggacttcatgggaagttttatgcgcaatacctttatattttcctttatagcctccgtagtcacgggcgtcgcctgctatgttctttccgaataccttatgaaaaagcagctgaacctggattaaggatttcaatcagtatttacagaggaagcagtcttggcggctgcttccttttttttgtgctgacgtttcacattttcaggtgaaaatctgccttctgcctatgtttctatcctcttttcgttttcaaagcccttttcagctttcggcggaaacttcctcccgtaagcgcatataataactgtaagcaataaatatgaggttaccgcaacatatggcaaacaaactgcatgccgcccagacatccgacagtccctatgcaggtgggctgaaaatcagtctcacctccagccttggcccgcttccgataaaaggcgcttccgttaccatctccctgacaggagatccggattccgtcgtagaaaccctgaccactgatgaatccggccagaccgatacggtggagcttcccgcgcccccggtagattacagcctgacgcctaccgaccagcagccttattccgaatacaacatatccgttgaggcatccggctttgagcccgtactcgtttccggtacacaaatcctggccgatgttaccgctgttcagccgatttccctgattcctgaggaacggcccggaagggaagaagatattataatcccggcccatacccttttcggtattttccctcccaaaattccggaggctgaaataaagcctgtggatgaaacaggcgaaatcgttttaagccgggtcgtcatccctgaatttgtcattgtgcatgacggcgtaccctccgattccaccgccccgaattactatgtccgctatacggattacattaaaaatgtggcttcctccgagatttatgcgacctggccggaatccaccatttatgcaaacatactggcaattatgtcctttaccctgaaccgtgtctatacggaatggtaccggaaccagggctacaattttaccattacctcttccaccgcctttgaccagaaatgggtctacggcagaaatatctttgaaaatatcagttttctggtagatactattttttccaattatctctcccgccccggcgtgagacagccgatacttaccagctactgtgacggccggagggtaagctgccgtggcttaagccagtggggctccatgtatctgggggaggaaggctatgacgccattgacatcatccattattattatggcagtgacatgtatattaattccgccgatgccatcagcggcgtcccttcctcctggcccggctacgatttgactataggctcctccggagccaaggtgctccagatgcaggagcagctcaaccgcatccggcagaattatcctgccatcccctatataaccccggacggcatattcggccagcagaccgcagcggcggtgagagttttccagcgggtgttcgggctgccccggaccggtgtggtggattttcccacctggtacgaaatttcccgtatctatgtgggagtttccagaatcgcggagccttcctgaaacaggaagggttttctccttttaaccagccttcttcatgcctcctccttatgcataaaggcggtacagataccttttaccgtatccgtaccgccctttttctctttattcttcaaaggtcctcatggccagtatggtgtccgtaatcagatcatccaggctccagcccagcatttctgcgccctgctcaatcacttcccgggagcagcccgcagcaaagctttttgtcttgaacttctttttcacggacttcagttccagatcctgtacgcttctggaaggacgcatcagcgcggcagcgccgatcaggccagttagctcatctaccgcaaaaagcaccttttccatttccttttccggctttacgtctacggtcaggccatagccatggctcgccgtcgcatgaatcagggcttcgtccagcccctcagccctcatgatttcctgggattttatgcagtgcgcttccggatactgttcaaaatccagatcgtgaagcagccccacgattccccaaaaatccacctcatcttcatagcccagcttctgtgcaaagtatctcataacaccttccacggtctgcgcatgcttcagatggaattcttcctgattgtatctggtcataagctcccaggcttcttcccttgttggtatttttcccatgctgtcatctccttcgctttttccggcaaaattctgcccggagtataatcggcccgccggcgcttatttcacagctcccatattatatagctgcttatatagccgccgcgcgcttattccgccactgcccggaatgcctcctccagatcctgaatgatatcatcaatatgctccgttccaatggaaagccggatagtattggggcggatgccctgttcctccagctcctctgcattcagctgtccatgggtggtggaggccgggtggattaccaaagattttacatccgccacgttggcaagtaaagagaaaagctgaagattatcaataaattttttcgcggtttccgctccgcctctgatctcaaaagtaaaaatagatccgcctccatggggaaaatatttggcatacagcgccttctggacctcatccgtggtaacggaagggtgatggaccttttccacctggggatgggccgccagccaggctgcggttttcagcgcattggaaacatggcgttccacgcgcagagacagggtttccagcccctgaaggaacaaaaatgcatgaaagggggacagcgtagctcctgtatcacgcagcagggtagccctgattttcgtaacaaatgccgcggggcctgcagctttggtaaagcttacgccgtggtagctttcattcggctgcgttaaggaaggatattttccgctcgcctcccagtcaaaacggccgctttccacaatcacgccgccgattgccgtaccatggccgccgatgaatttggtggcggaatgtaccacgatatccgcgccgtattccatgggccgcaccagatagggcgtggcaaaggtattgtccactgccagcacgatgccgtgggcatgggcaattgctgcaatcgcttccaaatccaccacatcggaattgggatttccaagagtttctacaaagacagcctttgtattttcctgaatggcgccttccagttctttgaaattgaagggatccacgaaggtcgtagtgactccggaatcggggaaggtgtgggccaggaaattataggtcccgccgtatatatttttcgccgcgacaatgtgatcgccctgatgggccagattctggaaggtataggcaatcgctgcggcgccggaggccacgcccagagctgcgcttccgccttccagtgcggccattcttttctcgaaaacctcttctgtagggttcgtcagccttccgtatatattgccccctgctgaaagcgcgaatcttgccgctgcgtcttcgcagtcatggaacacgtatgaggatgtctggtaaatcggcaccgcccgcgcgtccgtcgccggatccgcctgctcctgccctacgtgaagctgcaatgtctcaaatctgtatgctctctctgtcctgtctttcatctcgcctctccttcctgcctgacggcagcctgtacatggtatgtttacaattcctattggattagtatgtttttgttgattataatgggggatccaggatttgtcaaatggtttttgcaaaagttgggaaaattaaaggggatttttttctgaaattgggtcatggcttatgccagagcagatagcaggcagtgcagcgcaggcagcgtaatgccaggcagtgaagcgccacagcctggcgcaacggcggcagccagatactgcggcggcaaaaaagctgccctgaacaaaacaacagggcagctttttatcagttcattattactgcgtctattttaccgcagcctaaggttgtatttcttcccagatgaaggatacacgccgcattcagccagggtgtaaagggagccagctctccctgaaaggtcatggcgcccagcaggccgcttaaatccatttttttatctcttctggtggaatagcgctccatattttttacataaagccctgaggatgtttttgggatatgctgcgccgcttccatgagccaggcaatttcctgctcgtttacatagccgccgtaacgcgcggtaagctctgttatccttctgcttatgctccggaagatggttataaaatcaagttcggtcagcaggctgccgcttctccggatgcgaagcggggtcagcagctgtatggagcagttggtgcagccttcggttctgtgttctgagaggacttccgcttttatggcctcgggggcataaaggccgggcttccagattgactgaagctgatcatactgcatgatttcttccagctggaatctcttgcgctccgcccctatggtaaagctcccggcagttatgagggcattgattagctgctccgcataccggagggcatcgccaagaagtatcacctgaaatctgagttcatcgcctttattatactgctccctgtacccgggcgggttgatgatgtaaggattggggatatcataaccgccttcagccattttcctgttctcgtatatatatctgtatgcttccttgtgattgagcagcgcccatcccagaattccatggagggtggagcccagataaccgggaagccgggccggctcacagcagcgcaggcgtatcaggagcggaaggtatttcagggagaagtggacgggttcgttgtttatcatgggttattccaatcttatccaggcaaggccgtgggggagtttgttttctgtgtcgatgtatattgcgccggcggcttcgtgggggaatacgccggacaggaaattttcagggataattcttattatacaaggcatattaccttcgacattatagaacgattcaaataacaaggacttgggttatctaataatgaagtcgttaaatctcgatgccgtagcaaatgtttaaacaagctatgaggatacataagcctcgacaagaaaatgaggctcttaacgccttatatagagaatttcaatccacgaggcaacataagcctcgacaagaaaggtagccttattatagcagaggcgaaggtatttcaatccacgaggcaacataagcctcgacgtagaatatatttgggggcagcagtctgacattatttcaatccacgaggctgtataagcctcgacccttgctatggagcgtatcaaaacatataaggctcatttcaatccacgaggctgtataagcctcgacgattttacgtaaaattccgatggcgggtattcagtatttcaatccacgaggctgtataagcctcgactccgcaactattttagattttctcatccatgtatatttcaatccacgaggctgtataagcctcgaccggaagcggagatgtttcctatacgctggaatgtatttcaatccacgaggctgtataagcctcgacatgatccgggggtagatgtctgatgggaaagcagcatttcaatccacgaggctgtataagcctcgaccttccataggccgaataatagcatatggcgcttttatttcaatccacgaggctgtataagcctcgactgtcgcttttttaagataagaggccagttttatatttcaatccacgaggctgtataagcctcgactatcagtccggtttgtttcacgcatgtactttgtatttcaatccacgaggctgtataagcctcgaccatggtggattggaaaaacccacccatagaaaaatttcaatccacgaggctgtataagcctcgactgatgagctatgcgccgttgtttaatacaatgaagatttcaatccacgaggctgtataagcctcgacttcttccagtggaagcagcgtgtgatattttaatttcaatccacgaggctgtataagcctcgactttgcatagcatgattgccagcggcagcaggcatatttcaatccacgaggctgtataagcctcgacgctataccatacagatgtacgatataaccttccgcatttcaatccacgaggctgtataagcctcgactgcaagccttctacaatcagaccataccacaatatttcaatccacgaggctgtataagcctcgacaagggaccttaaactgaatgctaccagtacggagatttcaatccacgaggctgtataagcctcgacttccgaacgcttaccgtcagaatcacctgcatcatttcaatccacgaggctgtataagcctcgacagcaaaaacatacaaaaaatctattcaaaactttttcctaacacaacaattatacaacatctattaaattttatcactatacaattacaatatattttaaaatttcattactacttacaaaaattcggtgcgaatcccccggcaaattaatgtaagcttacgattcgcactaatttcaacatgacaatttgaattaatcaatctcatttcatcttttctttttattgatatatattgcacgtaaatttagtcagtaaaatttatatataacaataaaacgcattcttttcattccaataaatatccttctctacaagagcattccaaataatccggattctgataatatactcttgttttaaaatttgttatttcatcacttatgaaaaaattaaagattttaattaattcagaaatttccttccctggttctgcacaatcctgaatcataatacaatataactttcctatatacataaacccaggaataacatatttacaatcagtaattgtatcaaaattaccttgtggtattttatatgtttctatcacttcatcactaacctgttcaaaaataagacaatgatttacctcgctatatattcaataagagaacatacataaaaaaatcatttttttctttattcgtcatatactatttcactcccctgaaatgtcaaataattcaatcccgctaaagtatggaaactaatttgatgtgtcggatacttaaactccgctaaacccaaaattgttttctactgattgttcccgacaaaaaatcgttcacttaattccaaatcgtatcatttgccatcggcccttcaacaatatcgtaacgatgcatttctccctttctgcatgcagcaataaaatcaagccactcgtctgtcatactttcaaattttaaaactggcaaggtattatccggagtataaatatatgagtttataacaggactaccttcacctcgatttgcccagcgtacagcttgttctattttatttgtaatagaattaccatgaaaaatcttttgtatatttagttttccttatctccggaaatttaacaatttctttactggcatgatacaatatcataacgcctctgatatcccctatagattatcattatttctaacacacaaaaagcaccagcttaaacaacatactttttaccatgctctctaatacacaatctctttaaagcccattatatctttattccattgaaacagtgcagccttccccttttcatctcttattaaatgaacactgcccggttcaatttttaccctgtctccttcatatgcaatcttaccttctgttacagccgtcaacacagcctttaatatagctccgtgcgccgcaataattacattttgagcattatattttttcaaaatattatgaaatgccagtccagcacgtccaataagctcttccaacggctccattcccggatatatatcatcagtaaatcttttctttctctcctcataatccaaaccttcacccaatccaaaacctctttctatgaataagggctcggttacaatatcttctttcttataatccagcctgcctgcaacaatttcagcgctcttccgtgctcttgataagggactggatataataacatcaacattctgcatgcagccggctaatacttccgcagccttttcaatttggttaattccgttttggttcatcccaatatcttcatgcccttgcagtcttccttccaaattccaatctgtttcaccatgtctcagcaaataaatattcaaacctataattctccattccgttttctctcagacagtcttaaaaaaagattatacctattataaaacattaccatcattttcaacagctaaaataatgacctgctaaaataaaggcaagcacaatgcgctgcaaaaaatcaaagactgattcgcatgaatccctttgcataaacccatacaagaaacagggcgacaaaattcagtgcagatgctgtcataatcaaacaatttgcattattttcaggcatgatttcctgtgtcattacaccattttgcaatctcagtaataagttctgcaggaagcggcttattgtaaggaaactggatcgcacctttactggttttatattctttcagacgttcttcaaacatctcgatcgcctgtggcccgggataaaaaccaatatgtttcttaaatcctgcaaaatgaacaatattatgctgattccagtaagtaggcatgctccatgaaatacgctcttgtgcatccggtaatgctgcctgaagtattccatgcatttggtacaaatatttttgtatatcttccggttgttctaaaatgtaagcatcaattgtttccggtgcctttccacaaaaatgatcctgattctggtttttaaatgttcgtccacatttggggcatgtccacataatgatttctccagttcttttgattattattgttatctgatttcatgtaagaggtgttaaaggcttcttatttgccggctacgattttcctgatgaaattattcttacctgaattgggaattcaattcttgatatggaatgaacactgaccatctttctccaaacttacaatcaacgaggtcacgcaaacctcgactgaatttatgagagacgaagagtcggatggaggatttcaatccacgaggtcgcaaagacctcgacaactgaatatgcaatgcatgcgcttgatgtatatatttcaatccacgaggtcgcaaagacctcgacagcaccgggcgcggattgccactgcgaataatatatttcaatccacgaggtcgcaaagacctcgactctgaatccatttttatacctatttgcacatccatttcaatccacgaggtcgcaaagacctcgacaaagaggacgtggaggatgagcagagaagaactatttcaatccacgaggtcgcaaagacctcgacatacaggccttgtggcagaggttgtttctattacatttcaatccacgaggtcgcaaagacctcgactttaggatataagtttgtaatgtggattttacgtatttcaatccacgaggtcgcaaagacctcgaccgcaataccagatgcccgcccagcagcagccagtatttcaatccacgaggtcgcaaagacctcgacattctgctgttttcccgaaagccgtacaggatatatttcaatccacgaggtcgcaaagacctcgactgtatatagacgaaagtgtgggtgagatatgaatatttcaatccacgaggtcgcaaagacctcgacagtacattcttctgaaatcccttttcatcaacaatttcaatccacgaggtcgcaaagacctcgacctggattatcccttctcccggccatatccacatcatttcaatccacgaggtcgcaaagacctcgacgacaaggtaatcattggaccggaagattattccatatttcaatccacgaggtcgcaaagacctcgaccaggtccctgaaagccccctgaacagttatcaaaatttcaatccacgaggtcgcaaagacctcgacagcaaatccttccaaaaaccaaattccttcccctgcaaaatctatatttattatacaaccaccccacgattatttccaccaaataatcatctccacactatatttcatccatttctccccaaaaacaggtgcgaatcccccggcaaatccatgggaacttacggttcgcaccaactaaaatcatactcccgtcctaaaaaagtccccttttcttcatctctaaatccttcccttgtctgtcctccccagcctgagcttaaattactcttccctcttctattccgccgcaacgcccttcctgcccgcatcaactatctcataaaaccacacatacatatcctccggcctaatcgaaagcaaacgttctttatcaagcaaaattctatccccttctctgtgaaaaacagaatgaagcggttcataattaagagcctccagcccctccattgccgcccactcctgcaatgtatattcttccttttcaatcagcttttttaaagactcataaccagccttccgtacaaaattcagccggtcatctgttcctgtcatttcacaaagcctgtcattcataccgttccatagcctgtcgatacacatctgcctttcctgaaggctttgggctgaaaaatctccggtatttaatgcgccctgcaaatccttctcccagctgtccggtttccaggccaggcttctgctcatgtgaatcagccatttatcatgaggtatatattccctgtttacaataaaaagcgcactaaccagcggttttatcgcattattataaacataatgcccctgcatcgtatcctgcctgtatatccagatatcacctgccagtctttaattcaaatatgcttcccaaagcaatcccccggcactgtctatatcaaccgtacaagccagcttcctggatttaaattctgcaatttttccttcaggatcataaagaatatcagcataggacaaatcccataaagcggttgagtcatagcttctttccagctcatcttcataatttaccagctttatatcatataaataaccgtcaattaccgtaatccccaaagcaaccggacaatttccgtttttgtaccaatcaaaagctttttcatctcatcatattcctaatgcaaacataatagccgctctgacatacgcttcccggatcctgttgaaatcctcagttccccacttccatccgctttccgtctctgaaagcggatgtttatccgaacacagcagaactgctgccgcagtcatggaataatacctgcttacggataaaagtgcagacgcttccatatccacgcccacgcatcccttttcccgccaatacgcttccttggcaaaggtctggcgataaaaggaatccgtcgtaacggtagaattcacaaccgtatggaattttccctgaaaatattctcttacctgattaaaaaaatcttcctccggcctgacaaattccaccgtttcaaaataatgatgcgaggtgccttcctcacacaaaatgctttccggcaccaccacatcaccaacctggatttctttaccgaacccgccgcacataccgaccacaaggatccgtttcacgccaagtgccctgaccgtttccagcgtatcaacagccgccgggcagccatatccgcctttggtaaagcagacgtccggatgcccttttacctcaatacactccggattgtccagaaaacagggaagcctgtcacaaagaatgaccgtgtcaaaattttctttcaggaaccgcagcccgattccaagctcaaatattacacaggtttccggcagttctcttatatcccggctgccatgactgctcctcacatgcttttccgccgttataaccgccggcgtactgtcctctgaaaatacccacttcatgtcttcacctccctgcctgcagaaaacatcaccataaaaataattctcatctgtataatattttccgcaccgtctcaaccgacagcccatactcctcggccaattcctgcattttctgcttttccacataaaacctgcgccggatctcttcattgcgctgctcataatataccctggccccggatacggcgccccatccttttttctcttccttttccggaatataaaccagttcaccggaggaatatttttgtatttcccgaagcagttcgtccggaaaaatttcagaggcattccgatatttcatttcactccccttcctttctaaaaccgctttacgagattttgtttcgcgcggcttcttccctttagttccgtgaaaggaaatcctccagggaagggtactcgtttatttttcctccacgctctattataatcgctctcaccgctttttccagctcacagctttgcctgctcactttttccaggcagtcagggtcaaaaaagcctaaaagatccatttcctcaaagccaaattcctccgcagccacaaccagctcggtctgcagatagacgcagtcatgaaaagcttcctccggcatgttctgctggcaaaaatagcggattcttctccaggtaaggctcatttcctcataccagcctgacagctgttcataaccgtcttttttctcttttttcatttcagccggcctgcgctgctgcaggaagctccgggcagactgtatcagaagataaatcagctccctgatttcttcaatcgtatccgcccgaagaagctgctttgaataatcataaaatttttcaggaacctctttcagttcgggacagtgatacattctgctttccgcgctgccctgctccgcctgtttttccgaaaaaataccgcagtccgcaaaagtttggttcataaacgcggccgcctgcgtaaggaggctctggatatatcctgctgccatccggcatttgcatagcttttcttcaaacagaagcgtacggtaaatgtccatggccatatccacccgttccagagctctctgatacatcaaacctggattcctcaggttttcaaacaatctgtttttcaaagaaagaaaacgttcctcctcctcccgggtccttgcatacaggatttctgaggccgcaaggcacagtgtcgggaattcctccagatttgccgtcctttccgttctttcccaggaacgcgggtacaaatcatgcccaactccgtcaataataaaggtctgcgccaattcgtttccccgttcattgacaggcacataatagtcaaaacactctccatgaccgtcgccgtttgtggcatgtcctgttactcctataaggagagcaatgtcctcccggtattctttttcaattttttctttcacccactgcgtcagtctgttttctgcttccatattttccttctcctttgccccgcttttttatttgtttcttttacaaaaaggccgtccatgcttacctttcgatttatgctttgaacacccttcctatctcaattatagataaatcctcttttttctcaatgccgaatcccactatagtcatttgttcccaaatacagctcccggcataaaaataaaaactttgtaaacttttgtcgtaatacgcataaaataacataaacaatactaagccttataaaagggggcacgaatccaatgttaggaaccatacttttatgcgtagcatgcattttgatacttggtttcattttgtttatatgcatatggaaaatacgtaccaggaaattcaaaccttccaaagataaaaccggacagcagcagcagctgaaccaggatttgaaagatgcaggctttgcttatgatctgaaaaatgatttgttctactccgtcatggattgctggcagcgtgaaatgggatattgccggctgtatgacgaaggctccgccgattttaacatggttatgcactgtgagcccgtctgttttacgtacaacgggaaacgatggatgatagaattatggaaaggccagtacggaataacaaccggcgctgaaatcggcatttacaataccgcttccgatgatattaagacgaagcagttcaccggaacctattacgactgcgcctcggacgatgaacgtctggatatgagctttgtcctccgcaaaaacggaaaggttcttttcaaacgcagcgggattcactggtggcttaccgggtttaagctgggagaattttcccaccttgatactctcaccatggatgccaaaatcaaatttccaaacagaaccatgcgggacgcttttgtaaatggcctggtggatatcggttaccgcaaaaaagaatacagtgttcattcaaatacggttaccatccattacacaacgccccacagtccccagcctctttccaacagtacgcctcagggaattctggtgcagaatacaaactccatcaactgcggcctttacaggcaggtgaccggaaaatatacggaaactctcgataaacttgaatatcttaagacagccatgcccgaactgtatgaattctgtatgcattccctgtatgcgagatccttctatgaagcttttgactggctgattgaccttattcacaagggtcacaaccccgccccaggtccggagcccggtcccagtccttgtcccggccctgaaccctgtccttgtcccaagccttgccctaagccctgcccttgccctaagccctgtccgaaaccctgcccgaaaccttgccccaaaccctgccccaaaccctgcccctgctctcctgccactcatacaaaacggcttcccaacaggatctgtactccctgtaattgccagaagccgcagaatccctgctgtccatgcacaaacagcacagcatgtgaatgtgaggaaaaaaatactgaaaaagggatgtgccgctgatgccttcgcttgccgataaactgaataaagtctacacctccgctcccgttcttccctatgataaaaactcccgcatcgtaattatgagcgactgtcatcggggccagggaaacggagccgataattttcttccgaacagcccgatttttcaaggcgccctggaatattactacgagaatggttttacctatatcgaacttggcgatggtgatgaactctgggaaaacagatgcatccacacaattatcagaacctacagccatattttccggctcatgaaccgtttttatcaggataaccggctttacatgatatacggtaaccatgatattgtaaaaaaaaggaaaaatttttccacatcaaactgtacaaattattcctgcgatgtcacagaaccggaagattatttttataaggatttgaaaattacagaaggaattatcctcgaaaataaagatacgctgcagcgcattctcctcatccacggccaccagggaagtctgctcaacgatgagctttggccccttggccggttcctggtgagatatgtctggaaaccgctggaaacaattggcttccgcgctcccacaggctccggccgatccgtaaaactggtggaaaagatagagaaaaaactgtgtgcctattccagggaaactaaccgaattgtcatagccggccatacccaccggccggtattcccgaatccgggttcctgcccatatttcaatgacggcagttgtgtacatccgtacagcatcacatgcctggaaatagaaaatgatcaaattgccctggtccgctggtccttttccacgacggaggatcgattacttttcatcagccgcgaagtcctgaacggaccggaaaacctgtcggattttataatggactgaagtccttgccgggaaaccttattcctttgaaaccgtgctgtcccttactttccgataaaaccaacttccggcagcttacctggctgccgggtctgggcgaactgtatgaaaaaactatcaggctgttagcagctcatttttccagaagcatcctgtaatgattttccgtttcttcaacaatagaaaaacccagccgatgatatagatggataacaggattctttttaaatgcctgaagcctgactttggaaaatccgctgctttcaattgtttctgccagtaaacgggagccaataccctgattccggtattccggaagaatacagatattttccagttcacaggtatctccgtccacactccagtttatcatgccgatccgttttccccgggaataaattatgttcatattttcctttgcattttccatgaaggcattgaaatagtctgtctgcttttcttcatcccagccccagatctcagaaacatagggataatagcatattttcttcagctgataaacaaaatcgtagtccatcggcgtgtattttttcattgtgatttccataagctatcctttccatgggaaggaattaatccccggggcattccttcacataattttccataatgtcatccggcaggctgacttcatagctacataccatatcgccttttaaagcggaagtgaggacgcggccgtttaattttctgtccagaaacgcttctgcaaaattcattgcatgtctcaggctgcagctgcacagactatccgaaaccggggcttcagacaggatggattccttcgcaaacggacaatggcaggcatagtagcgcttcatgtgctccccggaagcgctcagatattccttcatgttcgcagggaaagcctgcatgtacaacttccttccttttcgtaccggcgccagtatcatgggattctgtctgataaattccaagacctcatctgtaatttcctctccatagaaatccttaccttctgcgttcattttttcaaaggcagccagctctttttgcagatgtccctctaaaaacttatccagatccccaaccttcagaaattccacccgcgcccatgctgactgtgagggcgtaacaccatgcctcactctggccaaaatcctgtttatcgtttcaggatctgtcatactatcaaatttctccataaaagctttcatattacagcactgacattgtgcctctgtctccatatcaggcaatatgagatcctctgtcagtttattccagaactcctcccccaactcgccgcatatttctcttttaaatgtatttatcccgaaactttcatcgtattccagatttgtatctcccatcgtgcttcccctctaccattttaaattttcttcctgaatggatagtaatgttatctttaaattctaacggtccaccatacaaaagtcaaacgaatcattatacttcactgcatgattccattcttcgtatagtacagtatattttatcttacccgctttttacgctataatgttttacaaaactgcaaataccaccgccaatacagaaaaccctttcacctgttctccttcagatgaaagggtctcttatttattgattcagttctttcagcaaatccaggatctccggccttactatctgattattgatatctaccaattcaaaatcaagacatttgtaattccacatagcatgccctattttcagtccgtcacagatagtgataaaatcacggatccattttacagcttctgtggcaggcgcggagtcaatgactccaaattccccgcagtaaagctcacaaccagaatactgcataaagtctttcgcataagaaagaagggacagcataaggcttttatcgttgcagtccgtttcttccgacatcaggggatgttccttcctgaacttgtcgtttgcttttagaaaggcaatataatccgtcatatctcccggataggtcaacgtatgcctgtatgcgcagaattcctctgaaaaatgcgccttctgatgtgtaaaagcattcggttcataataatggaaattataaaatacataagggtcttccactaaatccagccggtcaagataccccacgctgtttacattgtttgtccctgccagaacccaccggccgggatcctccttatgtatctccttgatcgcccttttgtacagccggttccacatatatccggtggagtccgcaatctcattgaataattcaaacaaaagcagagtccctttatatcctttaaaatgctctgccattctcgcccagaacaggcagaaatcatcacgaagcgcctcatccgtcatcaggggcgtaggtatctccatctgtccataaacatgcccttcaatattatgcaggtcaattacagcatgcaggccgtaatcggcacaccagccaatacaacgatccagatactccagcggcttttccctgagaattttcttttctttatccagaaacagccatccgcccaccggaatccgcacatggtcaaaaccccaggacgcaatctgttttatattatcctccgtaataaatgtttcaaaatgctgctgcaaagcttctttggaacccgcgtctgcgataagctcatattgtgacaggaagcctcccagattaagcccctgcttaaaattttcaaataacatattacactcctttttaagttatccttttaccgctcccaccacaatacctcctgagagatatttggaaatgaacggaaaaataatcaacaccggaatcgctcccagaaccgcgattgccatttttaacgttgccgtcggcagagaagcgccgatactgctgctgatgtttttcgccagtccctgctgcatatacagcgtatccaaaagcattctgttcaaaagcacctgaatcgtgtacattttatcattgctgatataatacagaccgttctgccagtcattccagtaattcagggacacaaacagccccagggtagccaggattggcttggacatgggcagtacgatactgcgcagtattctgaattcccctgccccgtccattttggccgactccagcagcgccacgggaatattagaggcgaagtaattcctggccataatgacataaaatccgtttaccagcaggttcggaagaatatatgcaaggtaagaatttttgatatggaatgtattggtccacatcatataggtaggaatcaggcccccgttaaacagaattgtaaaaaacaggaaaaagggaaaaaatgcctgcccccttaaatcctttctggaaatcggataggcatacagtattgtaagcaccagatttcccaatgtccccgcaatcgtaaccagggctgatatgccataggatctcaaaatgccgctggagccattgacgatatacttatatgccgttaaatcaaattgcctgggcagtatatgatagccctcatgaagtatcgccgtttcgttactgaaggaagatgaaaaaagcagaatcagcggcagaacacaaaacaatgacactaaaaacaaaataatatgatctattgtctgaaaaactttatctctttttaccatgataacctctccgcacagattgcaggcgctttctgctatttaaaatatggcgctgtctctgtcaatttttctgacgataccgtttgccgccagaatcaatacaaaaccgaccacagactggtacagccctgctgccgacgacatccccaaagtacccacactcttgattccccggtaaacataagtatcaatcgtgttcgttacattcatcaaagcgctgctgtccatgggtacctgataaaacaggccaaaatccgaccggaagatactgcccagctggagcagggtcatcgtaatgatagtggaacggattatcggaatggtaatgtacataatccgctggaatcttgtggcgccgtctatagttgccgcttcataatagctggaatcaatgctgataactgaggaataataaataatggaattatagccaagccatttccactgattcacagcaaccaatataaaaggccagaacgccggctgtgcataccaggaaacgcctttctttcccataggttccaaaacactattgttaataaacccggtatctgtacttaacagagcgtatacaatatagctgacaaccgtaatggatatcatatagggaataagatatgtcatctgaaaggcgcgcttccctcttttagaattcagttcatccagaagaattgctatcgcaagtcccacaaaaaggcctatcgctataaaaataagattgtaccccaccgtattgcgcagtataatccaggaatcccttgtggaaaacagggatttaaaattatcaaatccgataaattcacttccccagatacctttctgaaaattatactttttaaaagctatcacagtaaatgtcataggtatgtaattattgaacagcaaatatataaatcccggaatcagcataaggtatagagcccaattcaaatgcaaccgtctttttttctttttcatatatgccccgctttatgtgttacagagaattttagtactgcttttccggcctcaggagcgccgcagcctgcagcccgccataaggccggagtatttaaaaagtaaaattacttattatcagctaaccagttatccagctgtttttgtttttcggtgagaatcttttcgatacccgcttcctcaaattcagctttcatctgatcccatacggaatccggatccacatcccctgtttccagtccctttttatatttattgagaacagtggtgcaggccacaacttcattggttacgtccgtgctgtcccatacaaagccttttgcaatggagggatggcagtccttattaaactggattgtatcactccagatatcaggaccatccgtaacccacttatgggcaatcagctcattgggaaaatgccatgcggcaactgtccagcccagatcatcggcggtaacgccttccgggtaatcgataagccctttctctttatcaacaaactcataatattttccttcgatgccataaataagcaggtttgccacattaggattggaatacatttcgttaagaacctgcatggccctctcgggctgttcgctggtataagggatataccagtagttattgagattgctggttgtcgtataataagggacaatattgataatggtcacatcaattcccgtatttctttcccactgggattcaatgccgggtttggtttccgttgttgcgctgaaggcctttcccgcacccataaggctgcttacctgctccgtattgatgctggcgtcaggcataatcaatccattctgggaccattcatatcttcgtttgcataattcatagtattcgtcggaggtatagaaatttttcaccgtggtgtcatcgctgaaggaatccgtaagtacgccgaaatcccttcccagccagtcaatcgcaagcatatagtcccccattgcaccgctgtcggaggccagaggatatacatccggatacttttcttttgccgcctgaagaatcggttccatatcagcttccgtcatgatattgctgtaatcaacaccgagagattccagcatttcggtattacatgcaaatcccagtcccaatcccaattctttgttgttacggattgcataaacctgaccgtctatagatgtggaagctaaatcttctttactgatatcggcaagaatatcctggccgtcagactccaaaagttcattcagcgcaattacctgcccctggctcgccgcactcggaataggaagctgcgatacgccgccgagcaaatcaatcttttctccggatgccagttctgtctgtaccttatccacataggttgaaaaatcataacgtacaatttcaacctccgtattgaattttgcctttgtgatttcagaaacagcagcggaaatctccgcacaggcctcctctgatccatatccgtctgctacaattctcaccgtatatggctcctgcgctgaaagctccttttctccatctgcgctttcctgaccggcattactttcctgcacagactccgcctgcgtgcccgccgaagattcatttacactgttctccaccgtactaccgcctgaggaaccacagccggccgccaagccagccaccattgccactgctaataacacactgattttttttcgtaacataataccctcctttttcttttccacggaacaaactccgtttgaacatatagtttttcccgctcttaaatttgtaagcacatttttctgtgttgattaaagtgtagtaaaaagtcggttttgtctcaacaacaaaaccgaccaatgaatagaacgttttagacttttatattatctgccttccgagcgattataatattcgtacggagtcatatccgtccattttttaaataccttggtaaaataagagggggtatcaaaaccaacttttgttcccgcttctgttattgtacatgtcttttccgccaaaagacgtttggaaaccaaaatcctgtagtactgaatgtactgtaccagggaataacccgtggcctttttaaatatacggttcaggtaatccccattcaaatggacggcagcctcaatatcctgcctgcttaaatcctccatataatgcccgtgaatataattcttaaccgattcaacaaccgcccatgccgatgtggggcagtcaccaccctggactgcaggagaatgctccctgtccatagatgcatcaatcagcttatccacatcataaatgaactgccccatattccggtactgcatggcggcatgccttaaatccatggagcgttcggatagggtttccaggctgacgcgcctgataaaataggcaaatatctccccctggaaccttcctttgagcttggatataaacagctcacacatatcatggatttgcttcctgtcattatcagttttaataatccagaagatattgtcccaaagatgtatctccgtgatatcagcaaaaagctcttctgcaatattactcaacgcaaacagcaggatgctgttatttttcacctgcacctgggttcctgtcagccgtatatacaccagcccctttggctccagggattctcttgccagtcctcctacctcagccgctttattaataaactccgtaaaaggcagtatatcgccggtaatcaaattggtgtaaaaaatcttttcttcccttttaggatcatatacattctgtcccgcattcccctgaaggctttcattcctttttttattgatttcttctgcggcaagccttatggtttccgacagctcctcaaagcttaccggctttaataaatatttcacaacgccgatatttatagcatcctgcgcatatttaaaatccggatatccggtaagtataatcttcacaatatcaggaaaattttctcttatccatgccagaagcatcagtccattttcctgcggcatttcaatatcacaaataataatatctatttggttgcccgaaacaagccttctggcatccatagccgtataggcggtgaaaacctcatgaattcccagcccctgccagtcaatatgctttttcaaaagatttactacgattacttcatcatcaacaattaatatattcatagttccgtattctcatccttattcatccggggaatgcggatcattaccacagccccctgcacctcattccgaattgatacagcggcctgcccgccatacaatacctgcatacggttttttacattaatgatgccaatatgccttccgtcttcttcaatattctcattatcattcagcctgtccaggatttcaacagggaagcccagtccattgtctttaataattatatgcagcatcccgccttcttcctctatcagcagagagatttccaaatcctgtaccagcatgatgttatgcttgatactgttttcaatgaaagtctgtatcagaagcggcggtattttttcctcatcggcatcagcattacaggtaattctcagttgaaaattatcctgataccttattttctgcacctgtgcatagcgtacgatgcactggagttcatcttccagatatacataatcctccttcaaagacaacagatacctgaaatactccgccatgtttttagtaagttcctgtattgttacataatcctttatgctggcaagtgtataaatcaggttcaaaatattggtataaaaatgaggctgtatctgtacgcgcagaaactgattaaatatcttttccttttcaaggcttgtcttatacacatcaattttcagattgatgatctgctccgccatatgattaaaggtcctgtacagcacggtaatctcccggtttgttgtgtgatcctgcaatcggatctccgtatttccgccgctgaattcctccattgcatttttcagctttgtaagaggcctgaatacggatctgtcctggtgaaacagcgctatccatatcagaaaaaaagaggctattatcgcaattattatgataataaaaagataggaaccactgtttataaaattaaaataagggatttccacacagatttttttgttaatcattctgattgcacgtgagaaagtaaagcagtttttgtactcctcgattttatcagccttataaaaaacagagccgtccatattcaaaagatagacattactttcctgatcctgaggcataatatcattaagaacattttcacaactgatgtaacagccgctgaatccccctttatgctcatacagatgcaggaaataatcctttccccccagcttgatatccttccagtcagcagaattattgacctgaacgttcagtatatactctttcagttcatcattttccttctcctgaaaataatccagatatgaaattgaagaaagcataatattcttgtccggaataaagacgaaaaaaacaatctggttttcattgataatagacaggttggtcagatcacgctggagatcctaacttttttcttcaatgaaatccgaatcggaggaatcacagatcagattataatccgtgctgttgtttttattaatcagtgaagtcagttctttatttgccacataaaactgatccgcccagtaattactggaataattgagggaatttttgtaaatttcttctatccgacgattgaaatgtctgatggtaaagatattaaaaaccgcaaaaagaaatacgacaaagaaagatgtgagtaatataaaatagcctgattggataaaccttaattttttcattccgcaccggattccctgtatttgttattatgttcgtgtgccaaagccgcagccggctttccatgcgccactacagttcagtggcgcacagcaacattataacatatatcgaaatcaatacaacaaggtaaaattccagagctgatacaacggtgcagcagcctgaaatccaggctgaaacagtggtgttacaacatcggcaaaaacatggaacgcaaatcttctgcaaaagcatcgcggcataattttcctgtaggggttatttcccgccccctgccagccctaaacctgctccccatcctttttcgccaccggcatatactgggcaacctcagtttccccgcagatttccatggaatcaacaagatactcctccatgaatggctgcggtccgaagccgtaccgttcactgttctccatcttttttatgaagtcaaaccaggagcggccgttctgcgcatattttacaagccttttcagatacagcccgccgggaaattcctcttttatcacgccttccccgtcttttatttccatttcatacggaatctgtatatacaggcggtaaaaaaagccggggctgtccagcttttcaaagctataaaaggcgaagagcctgttctcttccctgccgggcaggattcctctgtctgccatccacgcggccagctgctttctcgcccgcgcttccgctccgggacctgtcgccgtgcaggatgcggtcataaaaggttccacatattcctcagtttcattggtaaactccgcctggatatcctttttcagccgcaccggcatgtataattccacgccgcccgtatgcgcaaatgcgtcatcaaagccaagatgctcttccagccactgggcgtcaccatatacatatttgctgccttccagccaatttgagaaacgcttccagccgcgcatgatgccttctcccagttcctcctcttttgtccgctcaattgtgataaccgcatacagaccaccgctcagccactttgtttttattttttcatccgtcacttccatatcctccggaatcgtgacgcatacctcatacccgtattcttccgccgaagggtcgcagtcaggcgcattataaccgaaaatacggtaatttccactgcgtatgtccagtttttcccgcaaaacccactggctcatagttgcaaatgcaccgtcctccggattttttccgtaataacagaaataagcaacacgcatgggtggcatttctttcaaaattttgatatccgggtacttttcattcatctcttcgtcgggaatttcaaaatatttatccataacatttatcctttcaaacttgtagtccgctctttcccgggaacaggcgcttggagagaagccggtgacttttttaaagattctggaaaatgcatcggcgctggtgtatgcgtatttaacggcggcatccagcaccttcatcccctggcatatatcataagccgcaagggacattctgcgcataatcaggtattcctttgcctgaaatcccgtaatggcaaaaaacaggcggtaaaaattcgaaaccgacatatacgcttctttcgccgcctcttccgccctgatctcattttccagattatcctccagaaaatctattgctttctgtatcctttcatagtagttcaccggcctgccctcctgcaatcttaagatgttttcagtatagcagacacccggacaggttacccgactttttttctcattctgctttagctccatgcatttcagaatttccggacgttttaaatgggttcctgcgttcacggacgccttcctttgtaccgacgattatccggtcgcagaatttgtcaaacaggccggtttccaatacacccggtattccgcggaccgctttcgccgctgccaggaaatcaatattttctgagaagctgatgtccagtatccagttgccgttatctgttacaaacggccttccgtccctctgacggcagaccgccgttcctcccagctctttgaccgcctcagccgcccaggcggaaccaaagggcaggacctctgcgggaaaggggaatgtgcccaggcgttttaccagtttgctttcatccatgatccagatcacctgctccgctctgcgggcaacgactttttccctgagaagcgcgcctccccctccctttaccgcacaaaagctgtcatcgatttcatccacgccatctatcgccaaatccactttaatcccggtttccggacggataatgggaatccccagtgaaacggcaagcttttccgtcgcttcggaggttacggccgcctgcagagcccttcctgcgcggaccatagcgccaacctcctgtatgagataatatgcggtggagccggtgcccaggccgagcgtcatcccgtcgcggatatatttaaccgaagccagtgccgctgctttcttcagttcttctttgatttctacatgatttctgctgtccatactgtttttcgcctttctgtgagtcactttattgatattctattgttccatttttacctattgatactgtaattatgattgttgcagttataaaagtcaatctgttttatacaaaattctggaagtcagttgatgggggcaattgttgcgctttcctgtgccgtacatttccggttgccgtacatttccggtttgacaaaaataacggcattcgttagactgaaaccataactggtccgtgtaaccctataatattgttcgtcatatttataaggaggccgaaattggaagtaccattttgggaagaaacatataaagacgatacagtttttacatttggcaaccaaccaaaccaatccattactgcaatcgaaaacctgctggacaaatcgggaagagtccttgacgttggctgtggcgacggaaaaaattcattgtatctggctaaacagggatttaggaatattgatgctttcgatttgtcggtaaatgcaattgaaaagctgcgccgtttggcagtggcacactctttagaaattaatgcatggactggcaatttatgcagctgtttacgaaccaggtgcctccctctcctgatattgcaccttttgctatcggtatggcagatgacggcgaaatcaggaagctgtatgaggattgggagattattgatttcaggtcgtatgtttttgaagacgagcaccccaatgttcccaggcatctgcatgcctctaacaaaattactgcccgccggataaagtgagggcgccgtccttttcagctttttcttcaaatcacttaaagccctccccgccaaagacggcaggaaggggcttctctgctgcagctttatttccactgaattatttctgcagatttatttttgtagcttcatttctgtggctttatttctgtaataccatttgtactgacttacttcttatttgtcccaacctctttatggtattacaaaccatccttaaagaaaccgttcctcaaaccaccttttcacatccgcttattccagaccaagcttcaccttcagctcattccagatatcaaatgcggagaaacgcatcggtatgctgtaatcatccccgctcccatgcaccggtgtccacacctgggcatagaacgggctcttacgggccatatcggcatagtgccaggtgttccgctggcattccgggcaccagtggccgccgcgcagcatggcgttgacgctcattttatattcatggccttccgaacatctgaaccgcagaggcgtataaatatcgggaatattttcatccagcagctcacagcctctgaaccgcgccgctttcctgatatcctcagcctgcagctcttccagcgccttgccctcatcatagccatgatccatataaaccggattctcctcggaaggatggtaaaattcatatccttcctccacactcttaatctgctgctgcttttctctggatccgaaaaatgcatgaatccagtcttcctgattattctccagcatccaggaggttcccatttctttatggctgattttttccaggttttccttcatggaccgggtattgggcatcatggcggcaatcatgggatttttcatcatcgcttccatttccgccgtcgcctccgcccggtagctttccggcgggattaccctgaaatgtaaaatatcatccagtaaatcggaatccgtataatagtggccatggaaattgtaaagcgcacattttgtcacatcaaatacatcctggtaacggattcccatggggccgaagctgaaattcatcagctcccaatgggcaaaacgccagcccttgccgctgcttaaattataggccttcctccagaactcctcaggcacccagtcctcgcagagattggccatgcagatgccggattccaccgccgtgctccattccagcacgttatttggattctgatggtgctggatcggctcctcgcccgctccctgatccggcgggtattgcccggtctgacgaatggaaacccagtatttcagtccgctgtcaaatacagaaagctcggaaaatacctttgacatcgcataataatcatgggcggaaggattgatgggatctccgcagcgtccccagttcacaggcaccggcctgtcaccagtcatggctaccgtacccacataggcgaatttcaccttgtccggatccggctgttccttaatggctttaataatattcagggtggatccgatattcgtatacagcgtttcttccggatatttatccgccgccggagataccatggcgccgatgtgcagcacataatccgcaccggttacacatttcagaattgtctcataatccttcatgtctccccagactacttccagataaggatctgcaatttttttcacaagctctttattctttgcggaaggacgcgccagcatgcggaccacaaatttcggttttcttgcaagcagctgcttcaccgtttcaatccccatttttccggttccgcctgttacaaaaacggttttgggcgcttttgaaatcaccgcacggtattcaggctgatcaaatttaacagccgcttcctgtgcttcaaaggtggcattcatcgcacggcgggcacgcagcgcatcccctaccttcacgaaagcgatgccttcattgcggcagatttcctccagcgccgaagcgtcattgcttctggaaccaaccgcgaccaccgcataatcacaggggtaagactcttcttttccatccctgattccatacacgcatccattttcaatccggtttaccgtgatatctgtgactgttacaattccacgttttgcaatttcttccattacacagattttacggacaggcccgatatcagcgcatacctccggcagcatttccaggacggtaaccttgcagccgctttccgcaagatattccgccgcttccatacccacaagaccgccgccgattaccacggcagcaccggacaccttcacctttccgcccagcacctgatgggagttcaccacattttccccgtctgcgcccggaattctcaggctgatgggcgaggaaccaattgcgcagattacggtatgcggcttttcctctgcgatcagttcaggggttaccggcgtattcagatgcacctcaatccccgctctttttacctgcgacgccatggaaagcatggccgccttcatttcctgtttgcggggcgcttcccctgccagcaggaactgtccgccaagatgatcgctgctttcataaatcaccggcctggcgccgcgttccttcaatacaagcgccgcctgcatcccggcaattccgccgcctgcgataagcaccttctccggctctttacagggaaccggcgccatctccgcttccagtcctaccgccggatttctcaggcaggtgatgtggggcatatccaaattggaaaaaccgtcatagcagccctgatcacagcctacacaggttatgatgtcctctcttcttcctgcctttgccttgttgcagaattcaggatccgccagctgtccccggccgataaccaccatatccaccttgtcttcttccagaatctgctccgccagctccggcgtattgattctgccgacgccaactgtcagcatgccggtttctttcctgatatatgccgcattatcaatattgaagccgcagggcagatcaagggaaggcacctcatatttcaaagccggcgttattatatttcctctggaaatatccaggacatccacgcctgcttcctttgcccatttacagaactgcgccacttcttctattgtcagcccgttttcaaggtaatcatcatgcgcatctattctcatgaaaaccggcatgtccgcagggaccgcactgcggatggcacggatggcttccagcgggaaacgcgccctgttttccagggatccgccgtattcgtccgtccgatggttgattccgcccgacaggaaggaatggggcagatagttatgcgcgcagtggaactccacgcagtcaaagcccgcttctgcagcccttgccgccgctttgccaaaacagtccgctatgtaatggatctgttccacgctgataccgggcagtgtaagctccgccgacaccggcatgtcagaggccacatacatcactgcggccggatcaaagcttacggcaatacttccctgccaaagctggatccccgccttgccccccgcttcatggatggcatccgtcagcttcttcagccccggaatatacttatcctctgcaatggaaaggaactgcttgggggagcttaacggctccacgctggctacctccaccatattcagtccgtttccgcccttcaccctggcaacatgatatcggatcagcttatccgtcaccattttatgatcgctcatacgggtacccattgcgggcaggataacacggtttttcagctccatccctttgatcctgatgggagaaaataatttttcatacataagttccgtcctccttttcttatatcttatattgtaaactattcataatctgtacagtcaatggtgtttttttattcagattttgttataattaacagaagatttgcacatgaaatgtatttttatccacaatatgcctttcgaaaactgttcacctggtgtacactttccggtagcgggccggatcatgtgcagggagaaatattctgtggtgaaggcttttgcaccgggcggacggtaacgtttgcaccggacggcagctttttttgataaaggaaggagtatccatgagaattaaggaagtgattgaaaaaaccggattatccaggagaaccatccaattctatatctcacagaaactgatcatgccaagagaagatccggtaaacggatatcatgatttttcggaggaggacgtgcgcaatctcattattatttcacggctgcgcaggctggattttcccgtttccgatatccgccacatccttcgtttcccaggaactgcttcctactatttctaccgtcaaatcgacactctgacgaaacggattgacaccatgcggcggaatgtggacatccttgcccgctattttgaaaatgatcctgcccccatcgactgcgattcccttgccgccagcctgaagctcatggaatcctatgaggaaaagaaggctgccaccgatgattttacggagctggacaagagaatcatccctctttttatatggacgccctatctttccggaacccgcagtgaataccaggaattcatctggagcaaaatttcccggaaggtaattgaggattatcagcctttcctgcgcagtatgaagtacatcatttctgcccttacgccggaacagctcacctacagcagcgaaaaaacagcgcagcaggctgaaattatagcgtccttaaagcatgacagccttcctgcccatgcggcctgcatgctggagcaaattgatgcttttctccggaacagcgcccttgtggaaaagtggaaccttgtctatccgccgctgatttatccgcttctgacaatcggatattccgaactgagcagtatgatgtttgaactgaacagtgattatgagcgtttttataataatatctgtgttctatgcggcttaatctggaacctgctgcagacaacagaacatgggacacggatttatgaggaaatcacagagaaacttcttcccattaactgggagcagaatgggaaaggggagcttgaacggatgacagtatttgcgttcagcccctatgccctgctggaaaaagaagacattaaaaagctgttattttgaaggattttaccgtaacagtccggcaattgaactgttactattttccttctgttaaaataaaaaacaaacgaggagtattactatgcagaaaaacctttcactttccattgacatcggcggtacctccgccaaatatgcttatgtcacggcagacggaaagctcaccgggaaagattcctttcccacctccggcctgaaaaacctggatgaattctatcagcacctgctgcctgttatcgataaggctattgcctgcggcgccgtaaatgtagggctgtcctgtccgggctttatccaatcggacggactgtgtatgggcggcgttgagaatctgccttatcttaaaggcgtgaatatccctgaattcctccggcaacataatccgtctctcaaggtatctattatgaacgacggtactgccgccgctttaggggagtactggctgggcagcggccagggcagccgtgtcctgctgtgcatcaccctgggaaccggtatcggcagcgctctgattctggatggcaggccatatccgggcagccattttcagagcggggaaatcggctacagtgattattcctcctctgaaaaatacctggaaatcaattattccaccctgggaattctcagaagggcttcggagcttaccggcgaacagctcgacggctttgcctttatccagcgcatccgggacaatgatccctgctgcctccggctgttggaggactggaccgaaaagctgggccgtatcctggcgaacaatatcctgatgcttgaccctgacagggtggtaatcggcggcggcatttcaaagcaaagcgacatcctgattcctctcctggaaaaacatacaaaccgccagcttccgccccagtaccgacagctggccgaaattgttcccgccaggctcgccaatgatgccggcctgttcggcgctgtaaaaccgttttatgaaacgggtatggatgcgtgacgctgctttgacgatttgccagcgctgccgtggtttaaatagaaaacgtcagggcttatggcaaagccagccagaaggcggttccttgcattccccggcctaaccggccaaacagacaggctcttcccatcgccattctaaaaatgcctcactcccctgtcctggagtgagacattttttattcaacctgggccatccacattctgcactgcacgcaaatcgcagaaagtgatccaaatatgcccaaagctactctgcagataatctgcccatataactatcgctattccatatctcctcaaattcttcttccctaatgaccaatgcaaaaaatcccccgccccactctcctgaattcaactctgccacagaaggtatggaaagaatctcaataacatcacgataaaaatcctctatacatttcactttcctgtccgcaaaaatctcaattgccctgagcgccagccgctcatcctccaaatcaacctcataaaggtaaacaacgggcatatcgtccgattcatagtcagcaaaaaccttgatatattccacattttctttcatatgcgcatcctccccggaatcagctaagcacagtaaatatccggcaatttcaccgataccatccacacaaacataaaccagcactcacccggctatgaattattgtccctatttctgcggtatccggatggggacatccctgtaaagctgcggaactggcggataaaatgggtcaggttattataccccagggactctgcgatggaggatatggtcctgtccgtaaacaaaagcgcattttttgccgaatcaatccttgcacggatgagatcctccatgggagatgtcccataaaaggatttgtataccgtataaaaacgggactcgctgagggggatacgggccgccatctccgccacagtccatggatgattcagggaaagaagcacctcgctgcgaagcctgcgtaagccctccgaggtggtggtatcaataacagcagtatactcatccgacagggaacgggaaagctttataaataattctgtcattttcagcattataagccggttgcttcctgatttccgggaaaaatactcgctttccatctcctgcacaatggccgttatcaattccggctggcgtgggtaaagaagtgtatccagcggaaggtccaggcattccggcagtccctccggcatttcggaaaaatgaaaccagtcatgcaccagcggctgccgcgcaatgaaatactgcggagtgcccggtgcataaatgatgcaggtatggttcggcgtcacagttcttaccccaccaatgacaatttccacactcgtaagaaaatgtacaaaggaataccccggatatccttttctcctgttcaggcagaaaccggcctgttccggccaggcatggcgaattccatataacagcggcataatattttttcctttctgaatttattacacattatattaatcgcagtaggatatgtcaacaaattcataggttatgtcattgaatatacaggaatggtttggcatgattgacttatacacaaaacatgaattattgggaggaaatgctatgaattcaagagaacgcgtacatgctgtccttaatcaccagcttccggatcgtgtaccgaatggattgggcggctgcgaaacagcaggactgcacgtaatagcttatgacaatctgcaggagcttatgggcgtggagcaaaagcccgccagagtagatacctttatgatgaatgccgtttttgaagaacccgtaatccgtgccatggacggagaccttatcctgcttgcctcccctaatatgtgtaaaagtgatctgcggggagacgcagccgggcaatggaaggaacagaagctctggggaaaaaccttctccattccagtgcaggattattttagtataaacagcgatggatacctggtctgggacagctgcggcggagtaatctgcccgaagggctcctattattttgatcagaatgaggctgttgacctgatggctgaaatcgaagtgccggatccggagcaattccatcccagggacacaattgaggaaaaaacactccgtaatctggaaaatgccgcgaaaaaattatatgaagaaacggatctgtctctctgtcttggggaaagcattaccgacctgcaggtagctcccggcggaatgatcggttccatggttttaatgatggaagaaccggatgtgatgcgggcgctgctgtcaaaatgcgtggaagcaggtttaaagcagattgagctgctggaacaggccgtaggaaaatacgtggatattctatcggtggcacatgactttggcgacaacaatggcgttaccatcggcgaagaactgtggagggatatttataagcctttttataaacagtttttccagggctggcgcagcatcaccaacatgaaaataaatctgcattcctgcggatccatcgcgtctatcttaggggatctcatcgaatgcggcgttcagatcgttaaccctgtccagacctccgccgcaggtatgtcggcggaagcccttaaacaacgctttggaaaggatgtggttttctggggcggcggctatgatgcacagcttattgatatatcctcctcttacggggatgtctacagaaacgtttataaaaatgttaaaatactgggcgccggcggaaattatatttttgcaggagtccataacctgcctgcgaatatgccggagcatcatctgaaggctatgctggatgcgtatcgtgatgcacgggactattagaaccggcaggaactaccagattaaacgaggccgccgctctcaattatccgaatggtggaaaatttaagcggacggcaaagcatttcattccccgtccaatgaatcccaatgcccgttggcgatccggtagacaggatcgtctttacgctcacagttgaccaatacggaaaccatccggtcatcaatttccggatcatctttcatccgatccaatacctcaaaagcgctctgacgcagtacatccgggtatcccagctcgatgaacgccatagccaggtcctttgcatcggctccgggctgccgtgcggcataccgcagcagccgcgccgccgagtccggatcctcatgatcatcatccatcgccagacatcgaagcccttccgcattcagttccacccccgggtacagcgccagcgctcccgcatcggcatacatggggtaacgctgcgctgcctttatatactccatgtcccataccggacggacaccggaggcgatcagcggaggcgttccccttcgtttccttcccaacgggcagtcaaagagtttttgctgcgcaggggtgatgatatccgccgccggcgtctcgctcccgtccggccagacaatatgcaggattccctctctccagatacgccccggacgcgatatggtcagggccggcactgttttttcctccagttcacaggcgcaggcgcggtggtgcccatccagaaggacactcatatatccccagagcgaataggccaaaacaggaggaagcgcctcccccgccctgaggcgccgccgatagttctccgcctgttgaggatcgtacttttgtgcgctctgcgcaggatagagatagcaggggaaacagggaagcacacgatgcttatctgaatcatagtattccgacgtcgctttgaatgacgtcaatgactccggaacatcccagaagaaatgcccgtcaccatcggttggatagcaatccgaataagacaatacataaattcccggctggagcaggccaaggaccggcctcacccgctccagcgcatccgcaagtccggcatatggcttatccaatgcagcccggaccgaacgaatttccctgcagtcctccggtatcccgtaccccgccgccagcatactctcacaggtaggggagccgttggcctgtatcctgagcagcggggtttcgcccagatacaggatagagcgatagtccgcttcgcatcctctggcttctttttccggttcaaaccagtccatgcttaacctcccacagctgccccgcacagcaagaagcagatgctccgagggaaatgccgccaaacaccccctgtgtcctgcaattacctctatcttttctttttgaaacagcataatatccctccccttcgccattttcacagcaccgtcccatcctccatgataagctttgacttcccggtaagcttcacgatgacatattcctccttggtgacagacagatatccggtccgctgtacagaagaattcatgcaggcggttccccgtgactggccgcgtagccagctggaatttatttatgtttttccatatactcggactttactttgtctattgtttttccaccaataccaaaatttttatctggtaattctttaatggtaacagagaaaaattcctgcggtacattcattatttcagatgaaacttctgttaaacgcttaatcagattttctttttgttcatctgataaagctccgctttcgattgttatatatggcattttactcctccttataaactgggattggtaaaaaaatggtttatggttggctcaggatatttcacaaataatgttgcaaatttatttgtttttggaaccgcctcatctaaaatgtctttgtccccacaccaaagtcctgttagcatttctgtagccggtctgtataatggaaaaatatttgttccctatcttctattcctctacacaactttacattgttttctatagccggcaatgtgctcaaagactcttgtttataagcttacgaatgtgaccatcagtatcgtttgaaagtttttttaatgcatctgtatcacagaatctaattgccagcttagctgcctgataacgtattttttctgcgctgtcatcaagaaataaatccaataattcataaaatgttttttgggtcgctctctcggtaattacttcagcaagtgcaatacggtgactgatgttatttgatacattaaaaagcaatttaaaaaattcaagattttcttgtgtaggggaaagctgctgtaaacacgcataataacatgcgtcaatttgctcatgattcttcaaaaaaaacgcgcgtataatttcatcgtgaatacaaaacttaccgctggagtacgtctctaatgctcttaaaataaaatggatatcatcagtcaacaacgcttcctgcaattcatcatttagcttaatggcgtaaggcatacgaaatatcacaccgaatacataaggccttttatgataatcattgtcagataaatacggaaacaaagcctcatacgcttcttcatcgtctttataggaaagagctgtgcagcaaacagaaaagcaggacatatctgctgcggcgtgcagtctgtcaataagctgtttggttgataaattatacggcacaataataccatttatcatttcaggcttcattttgaattccccctgtacaattatatttaaactcttatcctgcttcacccccttgttccatcctccgcagtcagcagcagctccacaatccctctctgcgcctcctgcgtataataaaacacctcatattcattccctttggaactgacccgtacctcggcttctatcccaaaatccttcccatattccgttatcttccgcagcggcatccgattgacgaatttcagttcaaaaagcccttcctccagcagcatctgctccaccgcctttatggtcagacgtttcgtggtgctctcctcccgtaaatcattcatctgacccacaagatcacttaaggacatccgcggggcatagtgtatctgcgacgcgatttcctccgtcatcacaaattcttccttcgtctttttcccgcttttcgtaccggccggcagttcctcttttcccgcatccgcttccagctccgtcaccccttcataatcctgcaccacatcataatccaggctggaaaaatccacagcgcccaggctgtccggttcatccgtcttgccgttctcccggttgaaccgggcaatacactgcaggaactgctctccgtatttttcaaacttgaactcaccaacgcctgatactgacagcatctcattcttatccacaggccgtatcacgcacatatgcaccagcgacttgtccgaaaaaacaatataaggcggcacgccttcctttcgtgcgatttccccgcgcagtccgcgcaggacttcaaacagcttctcatcctcctcatccagatcgaaggcggcagcgcccctgctctttttgcccttcttttcaccggcagccttcgcaggatgctcctgctccttcgccattttcatcatcaccgtctcatcctcttccaggataagctttgacttcccggtaagcttcacgatggcgtattcatcgttggtgacggccagatactcattcagcatcagataattcatcacctgacgcagcttatagacaggtactttggacagctccccgtaatgcgggttttcatccatccggtactgcctgattttcgccgtgtttgcaccatgcaccgtgtctataatcacattcgtcccataccgctggcggcaggcaagcacgcagcccagcaggactctggcaatctccgtcacgtccacttcttcaaactggcttaagcaattggagcagttcccgcagtaattggagccatattctccgaaataccgcagaatataatctctcaggcactcattggtaaaacagtaataagtcatcttccggagccggtccctgtccctctccatcacaagctcctttgtcagcggatccatctcctgattatcctggttattatcgataaaaaactggttcgtcaccacatcctggccgccgtagaggaggatacattccgccggctccccgtctctgcccgcgcggccggcctcctggtaatacgactccatattcttaggcatattatagtgtattacataccgcacattggatttatcaatgcccattccaaaggcattggtagccaccataaccggatatctgtcataaataaaatcgtcctggttctgtctcctttcaccgtcactgagtcccgcatggtaacgggtgaccggaaaaccgtctccccgcagccgctcgcaaacctcctccaccacttttctggtcaggcagtaaataatcccgctttcttccctgtgaagctccagataatttttcatcgtggcatatttatctttgggagtctgcacggcaaaatagagattcggccggtcaaagccggtcgtcagcacctccggggtacggagcataagaatatctatgatatcatccctgacctctttggtagccgttgccgtaaaagcgccgaccaccggccgctcaggcagcattccgataaactctgaaattttcagatagctgggacggaaatcctgtccccattgggagacacagtgcgcctcatccacagcaaccatggaaattttggcagttctggaaaaatccaggaattcctccgtcaccagccgctccggcgccacataaatgatgggatatcgtccggccttcgcgtattccaatgccttcctgtactgaccatatgtaagtgagctgttcaggaaggccgcatggattcccacgctgttcagggcccctacctgatccttcatcagggatatcaggggcgatatcaccaacgtaattccgggcagcattaaagcaggcacctgatagcagagagactttcccgctccggtaggcataattccaaggacatcccgtccctgcaaaataccgtctatcagcagctcctgtccgtccctgaagctgtcatatccaaaatactgcttcaatatctgatatttatccatttcgttcctccaaataaaaagcccgccgtatccggccgcctcttccttttttccgtctgttcttttccgttattttcggaaattcagggagatctctcttcaagactcacacaatacacacatgacaaggcacttacggcctcaacagaaattcgatgctttcatcctatcacagatatgtccggttatgcaatcaaaatgcgccgtttaccactttttttccatccgcctttctttacagaaaatctttttcccaaaaaatcctgccgctgcatacacgcttttgctttctgaggctttttaacttctgtttgtaagtttaacgatataactggaattaattaccaatttacataaataaaattgtatataattgctaaatttatgttttttattgtgatttatattgacaaagtttataaagtaatggcaatataataaaaagatttagtttaacgataaatataatattaatcaagaaagaggattgtccgaaaacaaaacagctggataaccggctgcttcaggggaaaaagcttcccggagagtgttttacggagaacataaattgtactcagggaaataacggaagcgggttttatacccaaaaggaggttttcagacagtctgaaaaaggagggatgaaaaagagtatgaaaaagcagagatttaagtcaggctttgaaccgcctgcgcattttgacagtggttaacctgtcagggcagacacacaccttccctatccattagctgtcggataagaaaggcaattatctacaatgcaggggactgtagccagaacctttttgcactgttttccgtttcgcggacaatgggcaggcaggacatgcaggctgcggcggcccttacatcatgacccagcccttggagaggggctttaataactactactaaccaagtaaggagcaaaataacatgattaaattttggagacagggtgcagctttattgctggccggcgtaatggcagccagccttgccgcatgcggcagcaccagtacaggcagcacaggaaattcagacaatgcaggcgcttccaatgaaggcgcaagtgccgaaaataccggcggcagtgagaataacggcgagattgtaaagctggtggtatggggcgtcggcagtgccgataccgaagactgcaacgaggttgccgccgctatcagcgaaattacccgcgagaaaatcggtgttgaaatcgagcttgtccgcggtcaggacgcagaacagatcaatctggctcttacttccggtgaacccatcgatatgctgaactataataacgttaacggccagctggctgctattgtacgtaacaactatgctacagctctggacgatctggttgaaaaatacggacagggcgctcttgaagttatcaatcctgttgacttggacgcctgccgtttcggcggtacactgtatgcacttcccgacatgaaggacacttcccgttccgctggtttctccatgcgcaaggatatcgtggacgaactgggaattgaagttcctgaaatgggtacttacgatgatatgtacaaaatcctgactcaggttcatgaagcatatcccgacatgtatcctctcgttcccacatgggccggcggcggtatgcaggaaactctgcctactgatcctctgggcgataacctgggcattctggaaaatgtttacaacgacaccacagaggttgtgaactattatgcaactgaaagctaccgtaaattctgtgaaatgatgtacaaatggaatcaggaaggcctgatcatgcctgatgctaccacaaccactgaaaacaacctgctctccggcaacggttttgcaatgtttgaaaactggaagcccggcaaggaactggaaaactacaagtccacaggcaaagaagtggtattcatgaaagtggttgagccttacaaatataccgacgtatccaacggcaactccttcatcattccttacagctcaccccatcctgaaaaggctatggagctgtggaacctgatgtataccgatcctgaggtttccaacctgtttatcaatggtatcgaaggcaagcattgggtatacacagatgattctaaaacctttattaccactcccgaaggcgtggatcctaacgccagcggttattcctccgttgactgggcttggcctaaccagcagattactcctctttggaagggtgctcaggctgacctgtgggatgagctgaataagttcaatgaaagcggtgttgccagccctgcccatggcttctcctgggacagcaacccggtattgaaccaggttaccgcctgcaacaacgttgtatccgcataccacacagcacttcgctggggcgctatggacccgaatgaaaaccttcccaagttcattgctgaactggaaagcgccggcatcaatgaaatcattgcagagaaacagcgtcagctggatgagtttctggcaggtaagaaataaactccggaaaccctgatataaacataagcatgcaaaaaaggaaggcgggtatgggttgctccccaacccgcctcttctttacacattatcaaatcatagggaggactaaaatatgaagaatgtcagaaaaaagctgaaacgattctggcccctttatttgatgttcgtgcctggcgtcatctatctgtttatcaattgctacattcccatgtttggcattcagatcgcgttccgacagtataacgccagagacggcatctatggcagtccgtggtgcggttttaaaaactttgaattccttttccgcacaaaagatgccttcgtcatgatccggaataccctgctctataacctggtatttatcgggctgggcaccatattggctgttgcagtggccattatccttaacgaagtccacagcaaaaaggccaaacagctgtaccagaccgtaatcctcattccctacctgatttccatggttatcgtcagctatctggcatttgctttcctgagcagcagcaatggttatatcaacaactcgcttctggctgctttcggcgcaaaacctatcgactggtacaacagccctaaatactggcctgtcatcctggttgtcatcaacatctggaaaggcctgggctacaacatgatactgtattatgccaccatctgcggtattgaccacactttgtatgaggcggccgtggtagatggtgccagccgttggcagcaaatcaaaaatgtaacactgcccggcctgaaatctacaattatcattttgaccctgatggccctgggcggtatcttccggtctgatttcggtcttttctatcaggttccccagaactccggtcccctgatcagcgtgacccagaccatcgatacctatgtgtaccgcggcctgatgcagaccaacaacatcggcatgtcctccgcagcaggcgtatatcagtctgttgtaggattcattctggtagtaaccgctaactttattgtccgcaaggtggacaatgagagttccctgttttaagaaggaggcagcatattatggtagacaagggaaaaggattccagatttttgctcatatcctgttgagctttcttattatttgtgcaattgcacctttcatactgctgattatgtcctccatcactgaagaacagactctgatcacaaacggctacagcttctttcccgagaagttcagtacctatgcatatgaatatctgtttacgaaatctgccgcagtattccgcggttatgcaatttcctttctggtgactgcaatcggtacggtgtgcaacctgctgttcaccacactgtatgcctatccgctttcacggaaggaactgccgggcaggaacatattcgccttttatttattcttcaccatgcttttttccggtggtctggttccctcataccttatgtggacccaaaccttccatatccgcaacaccgtattcgccctgcttatccccaacctgctgatgagcgctttcaacgttattatgatgcgtacctatttcaccgctaatattccggatgcggtcatcgaggcggcccgggttgacggcgccagcgaatttaagatacttttcggcatcgtactgcccatggccctgcccatcatcgccaccatcggcctgcttgttggcctggcctactggaacgactggatgaacggtctttactatctgaacgacgatcgtatgttcagtatccaggtactgctgatgaatatccagagggatctcgactccctgcggcaacaggcgcaggccggaggcaatattaacaccgccgatctgccttccacctcagtccgcatggctctgaccgtaatgggcattctgccggttatgattatatatcctttcatgcaaaaatattttgtaaaaggtattgccatcggcgctgtaaagggttaagcaaaagacttaattctccagtgccctcacagctacggaaaaatcacaaaagggaaagtccctgcggcacagaatgcccgggactttcccttttttaccattcaggaaaagttaccgtactgatatgggacgcaacgcctgcagtctcaagcttccccctgtatgtttcttcccaggaatcattccagcaataaagccggaagcacctgtaaaaatgatatccatacatacagactacggccagaaccagcagccagagcgcaaagcccatgaaatccgcaggcatgggctttgcggccattcccgctgccccggcccacctggccagcgctttaaatactagggaattctcagaccgccttccgcccccaagcgcctccggccccacaatacgcctgtcatcataaagaaatgtaaacaccgctgtcataagacagccaactgccaccccaacacctgaaaatatcagcttatcaaaataaaccttaagcctcacatagacctccaggctcctgtccagggcacgtcccggcaatttgccctctcccatgccgccgcagagcatcaggttgcttaaagaggccatcagcccgccggataataccatcgccgcttcttccgtacgcccccttcgattgtcaactatcagcgccggcgcgttctcttctgcatttaccgcatatcccacgccgctttcagcgaatttttcccactccttatcccgttccttctgtgtacggactcttccggaaccgccgaggaaaagccctacaacagcacagatcgaagaaaaaaatcccacaatcccggctgtcaggactgctgccgccagccccggaaaattccgcaggatcaaaaggaaataacctctcttcttctgccctgccagcagaatgccgccaagcaggctgcacataagtcccggtgccatataaatcaggccgacgcacgccgcaaattttcccagctccgccgcgcctttcggcttccagtcgaccaacagggacagataaaacgcgctgaagagcaatgcaaaaataccaaaaagaaaaataatacctttatgctccttatgcagtctgaaagctgaaaaccgttcttccttcataatcacttacctgctttttaccatatctgtttatcctgattccgttttattccggcttctgtgtattccatttcctgcttatcccggcttgtacgcatcctgattcctgcttatcctggccccggtccgtccggaatcaactctccgcctgcgcccaatccttgcagacatccacccattcacaggctccggagtattcctccagctcctccatgttaacttcaatcgcgctgttgctgctgccgcaggcagggaacactgtgtcaaaacgtttcagtgattcatccagaaaaaccgatatattctcattcacagcaaacgggcacacgcctcccacagcatgtccgattttctcttccacctcgacggcatgaagcattttcgcctttttcccgaattttgccttatactttgcgttatctatttttgcatcccctgcagtcacgataaggatgcagcgatcccctaaatcaaaggacagtgtcttcgcaattcttttgccttcgcagtgaagcgcctgcgccgccagctccaccgtggcgctggaaacctcaaattccagaaccctgccgtccgcattccattttttcaaataattccttaccttgtcaattgccattttcctgtcttcctttccgctgtccggccttttttacagaccctattttataacaatccccagcagcctcgcaagctccgccgcctgatataaatccgtcaccgctccccgcagctcccctttttcctccgacaaaacaatgccctcaatctcattcccgcgcagatccattccctttaagggcgtatggaaaaaactggcccgcttcaggttcagccctttccattccattttcttaaagcggcagtccgccagatagctttcctgcatatcgcaggcgttccatatcgccgattcccacctggttccactgaaattggcaaaagaaaggccgcactcctccatgcgtacctccttcagcaggctttcatggaaatccgcacctactccttttactgaaaggaattcgcagcggctgaaataacagtcgtccaggcggctgttggacaaatcgcaggtcttaaaccgcacatcgataaaactggctttttcgaaattacagtggaggaaggtacaattttcaaaaatcacgccttccagatttattttataaaaatcctggttttccgcaattagtccgcggatatggcattgctccacaggcatatcctccctgcaggcattgccaagaagcgccaggccgtcctctgcttccctgagcgaacgccccagctgcggcggcgcgactcttaccatttttttctccatgcccatttccccctgcattattttctgaggataagtctaacacagtacgtgaaaaaggaaaatggcataattgcacaaacctccgcgaacaaaaaaaggacaccggcaaagcgggaaacgctgctgcgcccggcttcgccgatgcctgtaaaggaggaaacttccaattccgtattatccaaaacgattgtccggcctgccctgcggcagacggaatcagccttcaattgctatataattatgctcttccacctgtttcttttcttcctttttgggaacggaaagcttcaggataccatgcttgaagctggctttaatatcagcctgttccaaatcctcgccaacatagaaggtacggctgcaggctcctgcgtaacgttctctgcggatatacctgcctttcttctcgtcttccttatccaggcccttctccgcgctgattgtcagatagccgttctccagctctacctgaatctcgtctttcttgaatccgggcagatccacatccagttcgtaggaattatctgtttcacgcacatcggtcttcatcaggcgggatgcatttttgccgtacaacggattctttttcccaaagaactccttgttcagcttcttctcccatttatcatcaaacggaaaatccatgaaatcatcaaataaattctctccaaaaatactgggcatcaacataagtcattcctccattcttctgaaatcagacaccagttaccacagcattctcctcttacagcggccttactctatccgggccgctgcattcggctttattgccgccggccttgtaagccttgccactttgtcagccttcaatcgcaatgtgcttatcttcttccaccttcggctgcgcttctttcttaggaacggaaatcttcaggataccgttctcaaatttcgccttgatatcgtcctgcttaatttcctcgcccacgtagaagcttctgctgcaggaacccacatatctttctcttctgatatatttgccattctcgtccttctcgccgttatctttgttcgtggaagcgctgatggtaaggtagccttccttcagctccgcctttaaatcctctttgttaaacccgggcatatcaatgtccagttcaaagctgccgtccgtttccctgatatcggttttcataaggctgttcgtgttgaaattcctgaacggaaagctcatccagtcgtcaaataaattttctccaaaaatactaggcattaacataattatcgctccttttctgtaaaataaaaattatcgtttacatgtctggaacgcaggttccgactccggtataaaagtaccctcatctttcgatgtttattgctttttgtatctttgtcctttcctttgttctacttgtaatataacacgcattattagcaatgtcaagaggtgagtgctaattattttttaatttgtggcgcgggcttaattgaaatacttacgtccagtccatccaggtgcggaggttttctttatatactcacctttttttcaaacaccagaacgtcctcacatgcggttgcattaaaaggtgcaatagcatttttccccagttcattagtgtatatcgtatgcagtctccatccatgagaagcatagtgcttaataattttctttattttatccttatttatattacctgtcagtttgttatccacagtaacaatatcatattcgtattttacatcctcttctaattcatcaataaacgtcctgcagccgcaattttcacacgtatctgcaaatggatccaccagggaatcacatattgtgcacctgacggcatcttcgaatttacttagcctttccccgctattttccatggaaaataaattatcaagatactcttttacatccccgtttatttcactgttatttctaatcttatccttcaaatattcaatttctgtctgaacgtcatctacggaatccgcattcattattttttcataatactcattgcactctgcgcaaacccgataaccggatgaaaacatcgccagggggtaatcttttatccacccactctgttttttaccgcaaatacaacatataatccccataactaatcctccgcctttataaaattaaagtaacagttcaggacgtgatccgtcctgaattgttacaattaaaaattattatttcattttatacttttaccccccaaagcgcaatactatcggaactcatcacccgttgtccgaaaatcgaatatcggagaacctccggctataatattgcaaaacagctccctatccgctaccgcttaaatatccagcgccgcatggtatccccagtacactgcattcgtgatgttggaaacctttgccgcgtctccaatcaccgcaacataaggcgctgcatcccgcagggaatccaccatattcctccgggagcgctgccccagggcacataccacggtcgtaccgggaaccagcttccttgtgccgtctgttttctcacacagaataccgtccgggcgcacctccaggcccctgcagccggtatgtactgtaacatatttttgaatctgctccaataaaagaggccgatggcgcacattggcgtcaggcgcaagctgatcacgcatttccaccagatggacatgtctgccctcctgtcccagatggacggcacattcacagcctgccaggccgccgccgaagaccaccacatcctccgtcaccttttctttttccagataataattgtttaccagaattacgttgtcccccttcagtccgggtacgggcggtacgaagggttcgcttcccaccgctataatcagtgcatcggcgccttctcgttccacatattcggcggttgcctccgtattcagacggatttccacacccgcatttattgccagagccgcgtaggtgcccgccagctcatacatctcatgcttaaaaggaattgcctgttcacttttcaggataccgcccaactccccctccttttcacagaggattacccgatgccctcttcttgccgcggtataggccgcgtataacccgccgggccctcctcccgccacaagcacttttttccgctccggcgcaggcagcacttcaacaccgtccatttcccttccaatcaggggattgaccgtacaccttctggtggaggtgactgcccgctcggccatacaggtaaagcaccgcagacatttcacgatctcagtttcccggttttcgcataccttccggggcagaaagggatctgcaagaagggctcttgccatataaacaatatcagcctgaccggaggcgataatcccctccatctgcgcagggtcggaaagcccgcctatggctgccacaggaacagatacatgcttttttatctccgccgccaaatatacgttacaaccatgttccgtaaacatggacggatgggtctggccaaaggtcttttgataggttcctgccgatacatgcagcaaatcaatataaggttccaactgttttgctatccgaatgccttcctccagatcgtaaccgccctccacaagctccgcgccgctcatacgaaattctatagggaagccccctcccacggcacggcgcacagcctgaagcacttccaccgcaaagcgacagcggttttccagacatccgccatattcatcttctctatgattaaacagaggggaaaggaactgattgatcagccagccgtgaccgccatggatcatcagcatctcaaagcccgcccgctttgcaagccctgcagcttccccataagaagcggcgatttcgctgatcagctctttactcagtgcctttacctgcactccatccgcccggatcccggcagatgcggaccactgagccatgtcatgccgcctggtactgtcggtcatgtaggtacctgcaaacatgcccgaatgagacagctccagactgggaatggcgccgtgcctgcggatagcatccgccgcataggctgcggctgccagtgaatttaatatcctggtatccagatgataggcgtgggagccgtctgtggaaggatggaccatacattcgctgacggtcactgcagccgcgcctccccttccgcgcagctcgtagaaagccgccgattttggcccaatacagccgtccgccgtaatatctgtaccacccatgggggcggaaaacatgcggtttcggaaggttacattaccgattgtaatcggtttacagagattctggtattttcgttccatatttttcctcatttcatttctcttaaagcgcagatattccgccctgccccggacactgcggccggggctgagagcggaatatctgcttccaaacaattattgtaactgtataacggttcagtcctcctcaccgttaccaattattatacaataaagcttccggcaaaatagccttcatgaaccacctcattgatgcgtctcggcccgatacagtcccctgccagcctgacatcatacaccacatccacaaagctttccgcctctgcctgccggggacgcaggcctgtacagtaaaccacattgtccgccggtatttcatagggaatcccctccgttccctgcagtacaatggagttttcctttatctctaccgccctggtattcagctttacctcgatctgtttattatcctttagcagctccgtcaaagcgccccggtaaagcaggtttcccgccgctgccagacgatccgttacctcaatcaaacttacccttcttcctctcctgccaagtgccagtgccagctcgcagcctgaggggccgccgccgatgactgccaccgtgcctcccattttttcctcatggaaatgggctgaaacgatatcatatacatggggtttatctatccctttgacaggcggtctgacgggaacggatcctgtggccacaatcagtctgtccgcgccgctttcctttatcatttccggagtagctttcgtatgcagctttacttctatccgatctgatttcattacctgtgcgatgagatgatttttgtaattcctcatatcaatctttgtctcatccccatcggaaatcttcagtagaccgccaagatcgccggtttcttcataaagagtgacctgatgtccccgctttgccgccgctacggcggcctgcatccctgccggaccgcctcccactaccgccacccggcaagcttccactggtccagtttcctcggttttaaggcgcagctgtctggtgtatctggggttaacggcacacccctggcttcttccttcggtagccaccccatagcaggacacacatcggatacagggtgtaatatcctccgtgcagccacatccggctttcctaggccagtccggatccgctatcagcccccggcccaaagcaaccatatccgcccaacccttttccaggatttcctccgcctcctgcggcatcataatcccgcctacagtacatacgggaatatgcagaacttccttcgcccttctggcaaactccacattgattccatgaggcaggatacttggtgtctcaatataagatgtaggcccgacaaacttatccagtccggatgaaatatgtaccatatcaatcttatcttctattctcctgatgaattcaatcacttcatcaggctccagtcccccttccacatactccttcgcgccaatacgcatatccagggtatagccggggccgaccgcctttcttacctcattcacaatcatttgcgggaatctgatcctgttttcaaagcttcccccgtattcatccgtcctcttattaaaaaacggtgataaaaactgtgccggcagccagccgtgggcaaaatggagcatcacagcatcaaaacccatgcactttgcttctattgccatattggcgtactggtcacaaacctgtttcattttagcttcgtccataccaatcacggttctgccgtccatgatttgattgttttccaccccttcatagccctgaaagggaatttcatccctgacaaaggtataagggccaacaggattgccctcccggtgcctcatatctgcaaacatgccgcagtgaaggagctgtacctcagccttggccccatactgatggatcagggatatttcttcattataaatcccttttctgctgccatttaagctgctggcctcatgataaatcagggattcctgatcctctactgccacgctgcccacaataaccatcccggccccacctcttgcctttgctgcaatcgtttccagctcatccgccattgacggaagcagtccgtacttagtaatgggtgcggccactatccggtttctcagcacaatattccccaccttaagcggcctgaacaaagccttatattcacacatatccaatctccttttatatccgcagacaatgagccgacacgttccggagtgcgttattccttaaccgcccccaaagtaattccttttacaaaatatttctgcaggaaaggatatacaataagcaccggcagaactcctgtaacagcaatcgccatcctggctgttgtggaggggaaattcgctcctattgttaccgcagttgcatttttctgcagataagcaatgctgtcactgatttgattcaaaataatctggatcgtataatatttggaaccgtttctctccgtcagataataaattccgttgatccagtcattccaatagctcaatcccgtcatcagcccgatagtagcattgatgggtaccgacagcggcagcacaatcctcataaaaacaccgaattctccacagccgtcaatctttgccgcttctttgagtgaagcaggtatgcttgttttataataatttttaaccaaaattacattaaaggcgctcatcatccatcccggaaataccagtgcccagatggtatccctgatatgaaaccagttgctccagatatagtaacttgccacctgcccgcctgaaaacaacatggtaaaaatacagaggaaattcaggatacgcacccccggcagtctgtcgttggaaagagtataggcaaacaggctggtaatcaccatgctgagcgccgttcctaccagggttacaaatattgtgtttatgtatcctcttccaatcgtttcccactgttttaaaatataggtataggctcctatactccacttttcagggaaaaagctgtatccgttagtgacggccgctgtttcgtccgtaaaggaagcaattatgagcagtataaacggaagcagcgcacacaatgtaaaaagaataagcactgcgtttgacaaaagcttccattttgtattgtccttggttctcatttccgacctccttaaaacaacgcactctcggcattatttttcctgacaagcgcatttgccgccattacgaacacaaatcccacaatagactgaaatacgctggcagccgacgacatggcaaaatctgaattcttcatcagagcattatagacatatacatccaatgtctgcgttacggaatacaatgcgcctgaatttctcggaatctgataaaacagtccaaagtccgaagaaacaattctgccaatagccagcaggaacattgtgataactgtgggtttgataagaggcagcgtaatcgccttgatctgctgccattttgtcgccccgtcaatggatgcagcttcataataatccttactgatacctacgatcgttgaataataaatgatcattgtatatcccacacttttccatataaagcagaaggtcaggataaagggccaatatttcggcttcatataccagttgacaggctttgcgcccagcgctgaaaaaatgctgttatttacaaggccggtatcatttgccagaaatgcatataccaggtagctggcaatgacccagctgataatataggggagcaggataatggtctggtagagccttgacgcgatcctgctgcggatttcgtttaaaaatatcgccaatgccacagcaatcacagttcccagaattataaacaggacattgtacgctaccgtattacgtatgatctggaaggtggactttgttttgaacaggaattcaaagtttttaaatccgtgccacgggcttcccagaattccttttgtcacatccagttttttaaaggccagaaggatgccaaacatcggcatataattattgcagatcatataaatcacaccgggaacagccatcaaatagagcggtacacattccttccagcgaagcttcttttctctttttttgatatttccagtcatatcatacctctgccgcctttcactgtttggcagcaaaccatgcgtccagctgtgcctgatttgcagcaatgacttcatcaatgcccgcatccttaagcgccgcaataaattccggcatgatttcttccgggttcacgctgccatagccgacaagtccaagatactgctccactacagcagaaactgccgcagcttctgaggaaacctccgaaggatcaaatacatagccaaaggtgtcacagatcctgccgtttgaaatcttttcattaaaagcgatatactcatcatatatatccgatgtaagaggcgcatatttcgggctggtaagagcatctccataaactgcgggaatcataacgttccacagagatccttcctttgcggaaacgatagcctttcctgtacctacttcctccgtaacctcatagcttactccctcaagacccgcattcaataaagctgccacactgttcccgcgctctctttcctgatatagaatgttcaaaaactgcatcaccttctcagggttctcgctggttcttgaaatggcataaaggccctgtgaagctgttaccgtagaggaaaaagcaggtatcattgtcatctgtacaaattctgttcccacactggtagccatctgggtatcggagcccggtatctgggaacctgtggaagcaaaataataaccggtctgaagctgggaggtcacatcatcagaaatcgtagttgcatccgggttaatcaggccttcctgcgcccatctatagatagttttgcaataattcatccattcatccgtttcaaaaaggttcaccacagttttatttccactgagaggatccagtacaacgcctgtagaaccgttgccgcccagcatatccacttcgtaaaaatcatagaagaactggccacttccctggctacttccgaacaatgcgattccatagtacccttctccgaagtgttcctttaacgcaagcagtgtttcttccgcttcttccggagtataaaccctggattcatcaacagtgattcctgcctgatccagataatcctttctgataagaaacccgtaatcgccgcccattgtggtattgcttggaatcgcatacagttgatcaccctgatagccgatggaaagcaattcgcccaacgttgatttgatgtctgaaccatatttctccaccagatcatttaatggaagaatcatattcttggaagtgtaattgctcacgctgtccatacctgaaccgcatacgaaaatattcaccaaatccattttttcccctgatgtaagagccatctgagattcattaacgatatcccatgcggccaccggctggagagataccgtggcattgatctccggcagaataatgtcgttgatcgcactctccacctgttccagttcctccggcgtctgcccccaggtaaccacctgcatggtaatctcatagggttccccctcatcggccggttcactctcggttccaccgcccgcatccgcttcagatgcactcgctgccgtggacgcggatgtatccgtggaactgccgcatcccgatattaaccctgccgtcattgctgccgccatcaataatgctgcaattttctttttcatactcttctcctcctttttcggaaacacttttgatatctttatcataaacaatcttctctcagatcaacattcagatttcttacctgtaccttttgaaaaaccaactattttccggggccggctattttcatattgccatttatgctatactgtctatgtttcatggacggtaaaaccctgttttgaaaggagggcttgattgtgaaaagtgacaaacgttccctgcgccgacagacgctcatcatcataatgcttcttgtccttccttttaatatacttaccgcgtttctgggcggaattatgctcacaaatgccatggaatccgctgaacttaccgtgcagtcctctttaaattcccaaatggataatctggatatgcgaatccagaataccatatattttctttatgattatcctgccaatcacgtttcctatatcaattttctcaaacagcccagggactggcattatacattctaccgatctcttacggtaaatgagctgagagatgatttaagcctctccacagcggcccaatatatgtttctttatgtggaatcaagggatgatctgatcattatgaacgaggagccttacatacggaatgaaagcaaactgcttctgtctgaagatgacgtcctgagcagaataaacgataaaaccatttccgattcccgctggcacctggtttccattcaggatctaccctttcttattatgataacacaaaaggagggtgtctatctgggagcgtgtatctgcatggcagaggctgtatcagaggctgcggcttccctggaatatgataatgtttccatctatgcgtccgtttcccccaatgccgatacctcctccggaatacactgcttcgctaaatcttcaaaaaccaatgtttacctttgctgcgatatcccccagaatgaaatcatcggaggaatggcatttatccacagggggattatttaccttgtgatactgtcctttctcattttccctatactgagtttcttttttaacaggtacgtcaatgcgcctcttgccaacatacgcaatgcctttgccgagctggaaaagggaaacgatgattaccggattacggccgtcacaaatctgtccgagttttcagatacctatgattcctttaaccggatggccgaaaagctcaaggagcttctgcttgagaccatacagaaggaacagcagcgccagcagcttgtcgtagataatctgcagctgcagctaaactatttgcagctgcaaatcaggccccatttcctgcataataacatgaatctattgtataccctgattcagaataatcaaactgatgccgcacaaagcctggtgctgtatctgtctgattattttcggtatatgttcaggaaagggcatgatcgggcgttgtttgatcatgaaatgaagctcatacgggaatatctggatatttccaggctccattatccggatgcctttaccttttcctgccagatcgatcctcttttaagccatgtccgtatccctccgctgctgttgcatgggtttgtcgaaaatattatccagcacgccctggttcccgatcatacggtgcacatcattatctatggtgaatatgaggatgggattgttacgattcaaatcgccgacgacggaatcggtatgaatgaagaggatacggcgttaatcaacagcggcgatttttcctcttctcctgaagggagccatgtgggtattaaaaatgcggtgctccgcctgaagcatttttatggagaaaaatcttctatcacagtggaatccgaaccggacagcggaacaatctttacgattacaattccctataatctgacggaggtatcagatgatgaatttattaatggtgaatgatgcggtacttgaacttcatactatggaaaagacgatagaatgggaaaaatacggcattgaaaaggtatataccgcggataacgcttcggcggcccggcttatcataaaagacacccctattgatatccttctctgcgatatagaaatgcccatggaaaacggtatttccctgatccgttggatacgtgccgggcaatacgacattgactgcatcctgcttacctgccacgctgattttacctatgccaaagaagcacttacgctgaactgctgtgaatacatactccttcctgccaaatatgaggatatcggcctcaacgtgcagaaggtggtgaaggaacgcgccagacggatccacgacagccggcttcaggaattcggtgaaacctggatccgcagtatgcaggattccctgccttccgaagaatccacaaatccaaaggaaacggtcagccaatgtgccgcttatattatgaaaaatatcagtgacgaagccctgaatgtagccgacatagccgcccatttttacctgaatgccatttatctcaaccgcattttcaaaagagaaaaagggatgaatatcagccagtggattatcagggaacggatgcttctggctgcagagcttctcaaaaatccctccaataccgccattgcggttgccatcagggtcggctacagtaattatccgtatttttccaccgtattcaaaaaatattacggctgcaccccatcccaatatgcagaaaaaaacaggctgcctgactaataaaaatccggcagcctgaagctttctatgtattttttcaaactattgtttcttccacggcccatgcaaaggatttctggatatattgattccagaaatcaaagtcatgcgtaccgctgctttcatggaatttgtgaggtacattgtgttcattcagataattttcaagagtcaggtttacatcatacaaaaagtcctccgtaccgcaggcatggaagacctgaggcatcttcgccacatctgtttcctctatgttcctgatcagatgctccacactgttctcgctttccattacggtatccaggttcccgaacagcgcataataaaagtcataatttcccccggcattctgaaatcccggctttgctttgtcaatttcatggataatataggccggcgacatggcaatgattttggaaaaggtatccggataagcaaaaccattccgcagtgcgccatatcctcccatggaaattccgccgataaaggtatcctcccgcttatcggaaagcccgaatctctctcttgtaaaattaacaagatcaataccgatatagtccccgaaacggcggcctgtccccggcccgtttgtatagaaggaattttcaccgttaggcagtatcattgccagattgaagcgatccgccataaaacgtatgtttccgcccaaaagccattccgtgctggaattgctgtaaccatttaacagataaattgtttttgtgggacgacggtaggcaggtgaatccttaaacatatccctccgcgctctggcatcatccggcagaataaaccggaactccgcatttcttcccaaaactgtggaataaaattccatcataccataagacatataaatacctcctcaattaaaatgcatcattctatttatattgtaaatgaaaagaggtatagttgaacattcactttttgaacttatacctttcagaaaacttacccttatgcctgccgccaggactgctgccggccaatgtacatcccggccaggatcgctcccggccgctgcgcgtccccggaaaagtcattttcttcattcacatcaaccccatcctcacctccgccacataggttccgatctgaaacaacaaccagacagttaaaatacataatataaaaattcccaataccgccagtccttcattgattctccgcttcatccggcggcggcgtcttgccgcggcattgtcctgtttattcataaaatcatactgcacttttcattctctcctttccatttcttaaccacgacttgattatatcagccgttttcctgccggaaaacaagagaattatgtggcatacaatttagttttttatgccataccatttttcgggatcttgaatacgttttgggaaatgttcttctttcttctgcctaccagatctgaatccgttcctccggcggaacgtacattccatccccttccttaattccataggtatcataaaattcctggaaattacataccacacggttgacccgcagaatgctggggctatgttcgtccgattccgccatagcctccgtatttttgcgggatgtggatctcagccaggcttttgcataggcccggaaaaattcatcataattaggggaagcctgctttttcagcacctccagggcacaggcattctcttcaggcgtacccgccgcctgtaccgtttcctcatattatccgcccaactccgtcacctctgcagcacttccaaacagtatcacggccgacattgccaccgccagcaaacgaaccaatactcttttttccatttacgctctccttttattttttgttatctgccatcagcccttatctttggaaaatgtactgtgaagggaatggtttttgcatacctttaagcattttccgcagcggatgcattccatagtattaggcgtctggtatacaggcagatccataggaaaggccctctggcatgccttgcagccggtacattttccctgattaacttcaaaccggtacagggcgatgggattaaacaggctgtagatggctcccatcagcgttcccgacaggcagattagcttgcaaaaccagaatgtgcctcctacagatgttcctctataatctttctccagccttccttatcaatttttttcatgacattctctccttttctcttgttctctgcctacgtgttttctcatctgatgaccttagtctagcatgctgttaaaacgcaaacaatttacttacattacatttttgatatgttgcataagcataaaaaagccggaagaactgccgcatcctgcggtatgttctcccggcatggccggtttaatccatgggccgcccgcttgggaggccaaatcctgctatttcttcctgaaagaaagcttcgcataaaaatattttaacctgttatctataaacgactgccaccgtccggcaaatgcaggcagatcccctttttgcaaatcctcttccagcagcgcgataaactcatccaggctgctgttcagctctccgttttccatcattactgctgaaaaaatatagccccatgctgccagctccctcaatttctcatagcattcccggataatagaagagggacattcactggagatgaagcttaaaagaacgtcaatacagagtatactgcttgtttttccatgaagctgcctgattctctgtaagaattcccccttcttcttttcttcggcagcttccagcgtaaaaagcgtcacaccgcttaccgtcagggccagaatctgcattccttctccatgcatctttaaattttcgcgtatttccggaatttccaaaattttaatatctaccggctccagacatacctttgtcccgattcccatatacgtcctggttacgcccaacgagttcagcacatccagtgtacggcgcaccgtgcttaaggacaccccgtaacgctccgccattttaggaagagagggaagatagctgtccacaggataatcctcccacagaatttcacgtatgatttcagaagcaagggtataacgcacctgaggcctccggcggcagattatccatgaaaagggaatctgcttcacattttccagatgatactcctcacgcgcagtctcaatgaaatcaagcacctcatcctgcatgctggtgaaataatcatcaaaatcctgtttcatatcattgatctgctcctgcgataaccttccctccacagcatacaccggccttttttcattccgttggggatacagaaatttcagatagcgcaggcactgccagtaaaggttaatcagcagctcattgtcaaatacacgcagaatgtcaaaatacagctttacaggcggcgatatggtaaccttccccttatttttaccattcccaaatgcactgtttaatacatccagctccacgacaggcgtccctattttccacataggcaaaaaaaggaattcaccggcatattggaaatcaatgattccctccttgcgcggtacaaaatattttgcggcattttcccggaatacttcttccgatccctgatatatcacccttgcggttttccgctcttctgtttctatatagccgtttttctccagcttatccaatgcggacagaaccgtgttccgccctaaccggaaggccgcgcagatctgcggcaccgacgacaaccgctccccatatctgtatattccaaaaaggatacgggattcataatattcataaatcagatctgtaagccctctgttttgttccatcccttttcctctttattcaaatgatttctcccacagcttcggcaagctgatgaaatatcatagaaattaccggcactctgtccctattaggatctgattcgattgtaacactctttgtacatggccgcaataaaagctgtacaatctttcgttaaaatccacaaaatcggacacagctcaaatccacgttggttcctgtcaacagcgttctttgtccgcctgctgattcggatatttattcccaacggtcaggtgactgaaggccgccccgcctgtgccaggctaaaaattcagcctgctccacaggccctgcaattcccctgggaccgttttccacatcctcgtccccatttcccagaaagagcggccggggcgctatcagggaacagatgtcgctgacatccgcaagctcccataaccccagaaaataattacagcagcacaaatgactgtgaagcatgctttcaggatagttgtgcaagtaaccgcttatgactgccaggctgattctctcatccatggccgcaagccacatggaggcctgtcctcctccggaaaaaccgacgcagccgatcctttctgcgtccacataatccagcccttccgcgtaatccatgagtctttgcatatcccagagcatcacgcctgcccgctcctgccgcgtcttcaggccccgccagccctgtgatgacgtgcagccccagcttctctgacacagcctgtctgagcgtccccttcaatcgcaggaaatcttcctcattttccgcacaaaatgcatattttccgcccctttttccacaggcatattgaaacaaatccatataggaataatgctccatcctctttctacgctcctcatgaaagcagtctgatttcttttgcaaaaggccctgtttcgattcctgcttccgcaaggctttccgcctttttgccccggatggaaagattttcgatagtaacatccgaaacgatatgctccgcatcatagcccctgatgcatgactttacctctccgcagccggtgtaagtaatatttttaaaccggatatgcgcaatcccgccgccgggcaccggattataatccgggttgcgttttacctgaatatcaagaagcttccccctctggaagggctctatacgaatgtcttcgtaaaccacattccgcaccgtatttttgtctcctgcattgatcgccatgcagcccagatagccgtcctggtgctccctgtgctccagaatatccagatcctcaaaacgaatatcctccaacacattcccgtcatgctcataatccccatgggttccgatcaccgtaggatgagccacgtccgcccacaggcagcagctggatacggtaatattccggctgtctgcgttgtaatcccatcttcttccgtaaatcgccacacagtcatccgatgtgcgcagaaagcagtctttcactgtaatgtcggtgctgctcatgatatccacgccgtccgaccagccttcacagctgaacgccgtgatatcttcaatctctattttttccgagccgcctatgtatacgctgtaatgcggcggattgatcaaatgaattccctctatcctcacattccttccatgactgatacggatggcgttcagccccccgaaacgctcgaaattggccaggtacagacaccccctgccatggatgcggatattttccctgtgactgatgataaaggttcccacaagaacggctccgccttcaagataaacctccgtatccgatggtatccgcatagcgcattcttccagataatgaagccccggcccgaaataaacacaccttccctccggaatccgctccagctgcctcaccagatcctccgtcctgtgcactgaaacctttttcaaatctcccggaaggaatatggtattgccactttccggttccggcctgtcttcccggatacgccccgctatcaaatgcaggttgtgaaaacgttccctgtttacttcaatggacagctttacaggccgatccagatgcagccttatcttcttcgaatcatattctgcttttatccccgccgatagcggacgcacatccacctgatatataaaaaacagcgccgggcaggtgatttccacctccgcttcctgggaaaaatcaaaatatgccatggacgcgcagcgcacctcatgcatatccacttttacctgatagcaggaaaccgcctgccactccgcctgcccggcggccctgacgcggatctgaaaatctttttgcaggacggcgccctccggcgtcggatagtttcttattgttcccatagcttcctccctgaatcgtcgccatatgttttcatttcaaaccagtcaaaatccgccgtctttccaaacccggtcagatcctggcagcagatgcctgccatggcgccggtaaaccacccctccaggcaggcctcatcggacataaagctgcagtccaggaccggaccgatttcggtaagcgcatcctccgcatagccaaaatagaactgcatgtgctccccctctacctttccttttaaaataattgcccttccctcttctattggaataaagcctatcgggtattcataccttttgttttccgccttcagaatgctgattacctttcccagctcttcatcatggctcacatgcagatacagataattctgatcatcatacatgaatatcagccccgccatctgcttgaaaacctccggttcaaattccatacaggcggatgcttcaaaggaaaattcagtccacctcctggctatcaggctctgggaaaaatggctggcaagcccggagcgtccgtacatacgaaggaagcccggacgttctgtcaggctgatgtaatgcgcatccatcgcaaccctgagggactgatattcccggtccagctcctcttcattaaaatcatcccgtgctgctttcccagggaacggacatagcggcagcttcggcgcatccgcttccgtttccggcaggctgtctaacggctccttatccaggacaagccagtcatcctccgtccatcttaccttttggattgccgtttcccgtcccagggtataacggcggcttcccgggaatcggggcgcatccgcgctgtttctggcggtaaggggtctcccgcaaagatggaccatgtaccattctccgccctgcgtctccaccagatccccatgtccgcatttctgaagggcaagctcctcatgatggcggcaggtcagaatcgaccaggcttcctctccggtatgctccataaaatccgcacggtacatttcgtatggcccccatacgctgcgggaacgctggatagtctgtccatgcgcctcaccggtccccgtgtccgccgaaaaaagataataccatccattccgtttataaatatgggggccttccaggaatatagtgtccgccgcatagatttccctcaccggccctgtcatttccttcctgaccggatcgtactcctgcagcaccaacctccccgcatatttcttcggcacccggtggtccgtcaccatgcttaccatatattttcgtccgtcctcatcgtggaacaaagacgggtcaaatccaaaattattcaaagcgatggaatccgaccagggcccatggatgctttccgccgtcaccagataattattggtatcgtacatattacagtaaaaggccttcacaaccgtataaaccagataaaatatccctttatcataggtcaggcacggcgcccagacgccctggctcgctcccacgcccctcagatccagctgaccggttcggttcagcggatattctatcagctcccagttgaccagatccctggaatggtgcagccttacgcccggccaccactcaaaggtggacgttgctatgtagtaatcgtcatccacccgaatgatggacggatccggatgaaagcccctcaatatgggattcttaatcttcataacgcactcctctttcatttcggattaccagggcaatccggcatctacttacaattctccttcctgtattccaccggcgtcatattttccgaagccctgaataccttggaaaagtaattggcattggaatagccgcagcgctccgcgatctccgaaaccttgatatggggattgcagagcagctttttagaaaggttcagacggtagtcactgatatactgctttacggtaacgccggtttcctttctaaacagcacattcagatgtgccgccgaaaaatgcatatccgcagcgatatccgtgacagacagctccgcttcccggcagtgctgctctatataggcaatggtatcacgcaccagccgggagtactgtgtttcctgctccctgtggatgccaaaggcctccaggagcctgtcaaacagctccatcacttccgccattgaagaggcctcccggattttctgttccgcatcctcctccgtatcaataccctccaccgacaaaagcagcgcgttcttctcctgtatcagaagtctggcaaaggcgctcatcagcatgacaatgtcctcctgccggtagaagccctccccgcatattttctccgctagctcatgcagccaggcggttacctccccggcgtcttccttgaggattctgtcaaactccgcatagagtcccggattgagctttttcatctcaggaatgccgtcttcaatttcaaatatccgcctttcacttttaaaaaaggactgctctgcattcagaagcgcaatttctgagcttgccgccacagccatcagattgtcggtttcaaagcctatgcccaaacacaggccttccttcagtccggccatctcacggcatttttccctgattcggctttgctgaaaagcgccgaaagcgccgaggaacagatattttccccgatccagcatggtcagcagataatctattcccgtatccttccagaattcggccgctaaaggctccagttctccggcattctcctcatttttgttccagagtactgcggtcagatagcctgctttttccgggaaaccgacctcgcggcagagcttttcgatcagcgctttgtccttggttttcagcttcagcatgtttaaaagccgctggcgttccagtttctgccactggccctcttttttctcaaagagctctttttcccggacaaacgttacggccttcttcaccgcctgctccaccttatccagttcaatcggcttttccacgaattccaccgcatccagggaaatcgcctttttcaggtattcgatttccatgtaaccgctcatgaacaaaagcttgctgtcagggcactggcgtatcagccgttccgcaaattccagaccgttaagcttcggcatacggatatcggtcagcacgatgtccgggcggaaccagcccgatatcgtcagcgcttcccggccgtccttcgcctgcataatctcgtcaatcccgtatttttcccagggaatggattcaatcagcccttctcttgcataatcctcatcatccgcaatcagtaatctcactgtgtttccccctctcccgtctttttcccgattcttatgctgacgcaggttcccacgccctgcgtgctttcataggtaatgcatttgtccatattataaaacagggtcagccgtgtctcaatattgctgatgccgtacttgcttcccttatgcttccgctcgttctcctgccctgtcgccatgcccacgccgtcatcggttacggacaggaagatttcatcgtcctcttcccagccgctgatcaggatggttccccggccgctgcttttttccatgattccatggacaatggcattttctatcaggggctgcagtgtaatttttgggatcaggaacctgcgtatctggtcgtccacatcgatctcaaacaggattttgccccggaagcgcttctgctggatggcaatgtaggcttcacaaagctcgatttccagcccgatggtgatgatatcctgccccttattcagtatcagcttgtaataccgggccagggaaagcacggtttccctgatattatccatctcattccgggaggccatccagttgatcatatccagggtgttgtacagaaaatgtgggttgatctgggactgcagcgccatcagctcggcccccttcttttcctggcccagacggtattgctcctctaaaagcatgcggatacggcggatcatataattgtaattgccaatcagctggcccacctcgtcctgtccctctttttcatccagagtttccagttttccttcccttacctttgcaaccgtcgtggacagctgcaggattctggcgcagaccgaacgggcgatcagccacaccgccgccagaagcgctgcgcagacagcggcaaagaatatgaccgtccacatcccggtttcccagaaaatcccctccaccgtatctgaaggcattaccgcaaaaagaataagcccgctgtccccgatttcatcccttctggcataatattccctgccgtccgcccggacctttccgccctccttaaggcaggcattttccagttcatcagagggtgctattttttcatacagggctctgtcgctgacggtcatcagctccccctgggcggacttgatataatacacttctttctgtggggtattcaaaaagctttccttcagcttatccgcatggatatatacatgcatgcttcccaggttcttgctgaaatcctccagattggtcacggggcggatgaatatcaggtactgcccgttttccccgttcttctccatttccccggtaagccataccggccggtagccgttcttttccatgagcgcatggatttcctggccgcgttcactgtcccagtccctcacatagccggaaatgctgtcggcaaagggataatcgccgtccagataaaaaaggcaggaatcataatccgtgccgtaatatatgttttcaatccagtcccaggccgactgcagctgtacatactgctggctgaagcctttgctttccatgaggttcttcagataataattcaggttttcattgccgatagccattcttgtgatgctttccacccgctccagacgctcctccagcatggaacgggtctgctcaaaacgctgcctggccagaaattcctgattgatttccgtggatgcgtaaagctgccggtaggataccgcaaaggccgcccccatggctgccagacaggcacaggaaaacagcaggaacatttttatggtaagcgaaagatcgctgaattttcccggaaagaaatgcttacgtggaatgcttccactccatttccagccggacagtctattccgaaatgaaatatccttcatgattctgtgccctcccgacgcgtgttttaattacgccaaaagccttcccgcgatccgtctgccggactgcaggaaggcggtgcctgtctttagtttgccgttttgctgtaactgtacggtatcttcccagttacgatttcttttccttgaatgtagtaagctgccgctgcatttcctctatatatttctggatgccggccttatccagctgtgcaagcacgttttcataatccccgtttctgtcctgtgttacaccgcagagcagaggtgtcatatactgtgcctttacagattccaaagccgctgtttccgaagaaagtgaggaagcatcgaagataaatccatccagagggctgaattcctccggggtaacccgggttgcgtccatctgctcctgccagtaagcgttttggctgggaacctcttcctccatatagccgtcaaccagcccggtccaggagggttttatatttgccgcatcgattcctgccgtggtaatttttccttcttccctgctatagttttcaccttccactccccacctgagcaaatcataatagtcctgatccgtatgggctttttctataaactgcagggcctttaccggctccttgcatttggggtttatggaaatacatgtggaattggatacggaaggaaggtatacgggagctttcccgaaaccataatcataccagcccatttcccattccggatttgttttgctgatttcgttcacggtcgccgtcagtgaccatgccggggaattggtggtagtcacctttttgtccgcctttaccagttccgaaatcttattgccttcatttgcgctcgaagccagaatatcgtgatcgatgattccgtctttgtaccatttttccatatattccagcatggttttgtattccggtgtttgtgtcctgtctaacaccgtatagggatcgtcaatggaaaccaccgtataaggagtattcatataactgtcaagctccagatatttgcctgcggccagaatattccatacacaggaccagatgcggctgtccattaccaccgagctttccggatattcatcctttgctttatacatgtactgttccatcgtttccaggctgttgatttccggaagcccccagctcttgcggagatcctcccggtacatgaagccttcattcgcagctacgctgtccgttgcttttccaaactgcggaatcccgtacagcttccctccgatttcacagctttccagcgtcttatcggaaaccacggaataatgggccaccagatcaggcacttcactgagcaggggcttcagatcgaggaatgcatttttagtcgccatcaccttataatctgaaaaattgccgcccacatacaaatcgtattcgccggaagcgatgttcaaattgattttattcttttcatcaccccaggggataaaatcaaaccgtaccttaattcccagatcctttactgtaagggcatccagctgctcataaaatgtatccatgccggacgccggctcatttcccatggtaaatgcttttaaggtaacagcttcaccggattcctccgcgggctgttcctgctgcactgtctgttccgtactgccagcatctgcagcgctttcaccgcctgccgttcctgcaccgcctgacgtatctgccgtaccgcagcctgccagtgacgccgccagaactgccgccgtccccaaggctaccgcctttttccatacatttttcaccgtaatcattcttctcttcatacccgaacctccttttttattatacatcaggcccattcggcctgtctgcataccacttgaaaaaatagctatacgtattcctgcctcagcatcagcccttaacgccgccaatggtaagccctcctacaaaataccgctgtacaaacggataaaacagcagcaccggcccagtggctataattgccgtcgccagcttcatcgtctcaccaggcagggaagcaacgctgtccaccagccctttctcactcatcatggcggacaggttcgccatcatggactgcagaaaatactgcagggtatacaaatccgtatttttgatatacagattgcagcggaaccactcattccagtagccaagggccagaaacaggccgatggtagccaccgcaggctttgccagcggcataataaccttataatagattttaaaatcaccggcgccgtcaatccgcgcagattccaccaaatcatggggaatgcttttcacgaaattgcgaaacaggaagatattgaacggattcatgaccgccggcaggatcaatacccagatattgttgtttaaatgcaggatattcacattcacaagataggagggaatcattcccgctgaaaacagggtggtgaaataaataaaaaaagcaaatttatttctgtgcttaaagtccggccgggatagcacatacccgcttacagaggtcgtcagcagcccgattgcagttccggccagggtaatgaaaatggtcacaaggtacgcctggggaatggaattccccatatgaaaaaccgaccggtaggcgtccaaggtaaattcctgcggcagcagggaataaccgttgaccgcaatcgcagattcgctgctgaaggagcctgccaatatgaaaataaacggaatcacgcaggccgcggccagcagggaaataaaaagcatgctcaggccattgaaaactgccgccttccagccgtgccggatatgtacatcggcctgtacccggccgtccatcgtttttcttttctttttcatttaagtctccccctaaaacaacgcattttccggactcaccttattcacaatccggttaaccaccatgaccagcacaaatccgaatactgactggtacaaccccgcggccgccccccgccccatgttgaaatccaccgccagggaacggtaaacataggtatctataatatccgttttatccagcagcaggccgttgttccccacaatctggtaaaacagctcaaaggagcctttgataatccctcccagagccagcataatcagcatgatcgccgtaggcttcagcagcggaagggtgatatagcggattcttttccagttggacgcaccgtccacataggccgcctcatagatgctttcgtcaattccaagaatggccgccatatagaccacgctgccatagcccagccccttccacacctgcaccgccacgattatggccggccacacctgtggattctggtaaaaatcaaatttttcaaagccaagggctgtaatgatattattcgctatgccgtatttgtagctgaaaatgttatagacgataacccctatggtaaccatggacacgaaatagggcataaacatcaatgtctgggaaacctttacaaaatattttctgtgtatctccttcagcagcacggccaccgttatctgcgccaggttgccgattaaaataaaggccaggttatacagtatcgtgtttttcgtcagcttccagatgatggaatccatgcctcctgaaaaaaggaattcaaaattccggaatccgcagaacgggcttctcagcccctgcatgaagtcataatccacaaatgcataataaaggccgggcatgggaaggtaacagaaaagcaggaagaaaaccaccatgggaatcagcataaaatagtaggttttatgacggcggaaatcatcaaagggccttttcttttttactgccgcctgcatattattctttttcataaattctccgatccgtgcgtaaatacacacctgctgctttttgaaaccgctttgctttcttgcttatattcaggatagcggatccgggcagcggaaaaaatatgactttttgattaaaaagggtaatttttgaataaccggtatggcccgggcatgcgtcaaacgatcttcagaccaggctttgtatggaagttttccatcccagagctgtaatatgaaaaacttccacacaaaaaaagacaaccttatatgattgtcttttttgcatgtacttattaaattttactttgttaattgtctgctttcttttcttgcctgaaatcctgttccgtgttattccttacaccactttttccgctccaccatccggcccatcaggaaggcaattatccccactccgatcccggtctggacgcagaataaaagactttcaacctcgcccgggatttccccgttcagggcggtttcaaagacaggcgtgaaccagggctcatattccccgacaatctcctctatcttctggctccccgcgtcatctgagccgccaaattccgctcccttcctggcaaacagcggcaccaccacaatcagtaccaccaggactatcagtattattgctgtttttgcttcttttttcatggatttacccctttcataccgcaggcaggcctgcgatactgcattaataagtagtttgaaggaactttcaaacttttgcctcctgtataccgcagggaaagcccgcggcatcaaagcaatctctgcccgtaactgcacgttccttcacagctgcctctgctctatcatttaccggccttcataaaaccgattgcctttaactccggcttcgcatagttttccagcgccatcataatcagcacggtcaacaggccttcaacaacggccagcggcagctgggtcggcgcaaacacgccgaggaattccagggcggacgcaaatacgcctccctgcgtgctgggatatgccagcgcaagctgtacgcccgttacacaataggtaaaaagatccccgaagaaagcggcgaggaaaatcccggccatcctgttcaccctacattttttgcagagcagataaattccataagtaacgaacggtcctgcaatcgccatggaaaaggtattggctcccagcgttgtcagtcccccatgcgcaagcagaaccgcctggaacagcaaaacaataatgcccaatatgctgacggtgccggggccgaaaaggattgcgcccaggccggttcccgtcatatgggaacagcttcctgtgacggaaggaattttaagtgcggacaggacgaatatgtaagcgcccgccatggccagcatagtgattgcctttctgttttcctgaaacagcctgcgtatggtaaaaaaaccttttaccaggaacggcaggcagacaacgccccaggcgatgcagtagccggccggaaggtagccctccataatatgcatggcattgaccgttgggtatactgcaaaggcaacggaaaatgcaatgctcagcttcaggattttcttttgtttctctgtcattcttttgaatctcctctctcatttttacaggcagtgatccattccgccgcctgctgcggggtggacgggtatccctctcgatccgccaccagcccatttttaagcaacgcgtcccagacctccataatggatggcttttttaaatgggccctttccatcatttccttttgggcaaatatttcagccggcgttccgtcaccaatcagcattccgtcgcaaaaaacaagaatcctgtctgcaaaacgccaggcgaaatccacatcatgtgttgcaaccagcagagtttttccatcctcatgaagcttacccagaatatcctccaccctctgcgcattcattggatccagcgcggccatcggctcgtcaaatatgagcagctcaggctccatcgccagaatatcggcaatgctgacctgtttcttttcccctccgctcagataatgcggcgcacgctgctgcagctcttccaggccaagataggaaactgcagcatccaccctgcgtattacctccctgcgttccaggcccagattcatgggcccgaaggaaatttccgcccatacattcgccgcaataatctggctgtccgcatcctggaatacaaaacctacttttttgcgcagcaggttcagctcttttttccctattttgcttccgcaaagaaggatttccccggaatcaggcctcaataccccgttcagattcaggaaaaaggtggattttcccgctccgttcgaacccataaccgcaattctctcaccgcgcctgattatgagattcacatcttttaaaaccggttcctccccgtaggtaaaggacagtccctttacctgcagcaacacttcattttccatatgctctcctatacaatgaccgcgatacccaaaaggacaatcaggtaaagcccggtaaaaacaagctgtcctcccacaggcggtttttcttccgataaaaattccagcttcccgtcgtatcctcttgacagcagggcatcgtaataagcattcgctttttttaacgatacaagaaacaggttccctgctatctgggcaaagcttttgcaggactggcagaaagaatggcagcccagccgcgctttcgctgcgatctgcatttgctccgagacatctatcaggataaaaatatatctgtatatcaggttcatcaattcaaccagcaggcgcgggaggtgaagcctctgaagcaccagaaccagttcgctgaccggcgtggcaagggacatcatatataaagcgctcattccggccattgccttcaggaacaccctgcctgcaagaaccaggttctccttataaaggcatatccagaaaaaataggccggaagattccagtctcccaaaggcgcacggccaaattccacggcaatcgccgcgccgctgaaaaccataaaggcaaggggcaccgtcataaaatgtatgtaggccttccatggtattttccctttcaccagcgtaagcgctcccatggtgaatatcacgtaaacggaaaccgccggcttatcaaaggctattaccaggcaaagcgtcatgaccgcaagaaacattttcagccctgcattccagcagcgcattcctgaacgatatgcataataatctattttcatcctatattccctgtatgtccgcgatccggcccgcgcaaatgcatgtgccgcctgaatcacagcctcttttgagcataaaaaaacctgcttgtacacaatcggactgtgcgtacaaacaggcaacaaaaataaggccctcaaaagggcttattttataagttcctgtccatcgcagtccctataaacacaaataaaaaggcaggtcttctgacttgcgcatcctcacattttctcgtcttcccatttccacagtgaccgccttccggctgaaaaaatgctccgcgtatacagcgacgggatcgtccgggattcccacccggttccctattatcctgaactgcggcaaaaaaccgcatcaggcacctttttacttcaaatttccatcagtatatcattccttgtaaaatttagcaatgacattttgagattacagccgctccgggcaaaaccactccggcacatccctcctgaaattatcaaaccaccgcaaaacatccttcacgtgtttcacagcatacggaagctcatccttctgcaaataatatgcccagggcaccataataaccgcgcctacagccagataataggcaagcagcttccaaaattgcaacggaggttccccgccaaaatatccccggatcagacctgtaacaaaatacggatgcacatcggtaaggcctatgctgccaaactccttccagggatccgcataattatcaaaatcaagcagctcccagtcgattacagacacctcacccgcatcagttatcatcagattgccaacatgataatccccatgctggaggcactgcggtctgccgttaagcaaatgcctgttattctccacaaaggcaagcaaaatatcgctgccgtcaatctgaatcccgcaatctgaaaaggcctttatccggcagtcgttttcactaaaataccttttctgccagggttccagttccggcgcaggtatcgtgtggatagtccgcagtatctccccggcttttatgcctatgtcatattgtttcgcttcggacagggacggcaaaagcttttccccattccttccctcacaccaggtcaaaagctgataaacgcttctcccatcatcacagcttccgaaagcaacgggcctgcacatgggaatgtcaatgctgtcggctttccgcattctatcaaacgccgttttcttccgttcatactccgttccatccgacaaccgcagcaaaaagtgcccgccgtctgaagtctccacatgaaatttcctgtcacccgacagaccttccgtactgtttcatagctttttatatccagcttttccatcagttcccggcatatttgcgcacctgtatcttcctgctccttttccgcccatcctgcatccatcattccatccccctgccgtttcagtcaatcccatacaaggcacgaatggcattcccaatccgcctgatcccttccacaatcttctcctcctgcgtattggagaaattaatccgcatcgtattggtttttccgctgttgggataaaaggaatcccccggaacaaaggccacatcctgctccaggcatttttcaagaagcttggtcgtattcacttttccatccagctccacccagaggaaaaggccgccctccggcttcgtgtatttgatattgtccgggaaaaaacgttctatagaatccactgccgcgtcacgccttctgtggtatacctcccgtattttatcaatatgatcgtcgatattatacttttccaggaaagaagaaataaccatctgcgccaccgtattgcactgcagatccacgccctgctttaccagcacatatttgcgtatcacctctttttcccctgcgatccagccaatccgatagccggggcagaaaattttggaaaaggttcctgtacacagcacatttccctctttgtcaaaggattttacggagggcaggaaatcgccttcataccgcagctccccataaggattgtcttcaatgaccacaacgttatattttgacgaaagctcagcaagctgacgccttcttgccaggctccaggtccgccccgtaggattctggaaatccgggacaatgtatatcagctttgcctcgggattctcttccagagccttttccagccgggagattaccatcccatcttcatccgtttccacctcggcaaatctgcagccgtaagcccggaaagcgctgatggccgccagatacgtggggctttcgcacaaaaccacatccccttcctccagaaaaacctttccggtaagatccagcgcctgctgcgacccatgggtaatcattatattgtcctcgtcaaaagccgttcccaaccgggagttcatccgttccgctatccatctgcgcagcggctggaagccttctgtggtcgtatactgaagggcctgctctccgcagcagtccagcacataatcgttgaccgccttgatttcctgaatgggaaacagctccgaggcaggcaggcctccggcaaaggatatgacctccggcctttccgtcagcttcagcagctccctgatttcagaagccctgatattggataatcttcctgcatatctgtattccataacaatctcctcctgccgttttccgaaaacggcacttttttatatcactgcccccgcagtggtttttcttataaaataggactgatttcaccgtctgataatgctccgtcctctttttccgataccgtcagcttcctgataacctcgcataaaaccctgatcccctccgtaattctgttcctgggagggaaggtgtagttcaggcggatataattttcccccttctgtcccggcagatagaagggcgttcccggaaggacggcaacgccattttgcgccgcctgggtggcgagcaaatccgcaggcagcccctccggcagcctgcaccacaggtaatagcccccgtccgggtgattccaggtgaggcccggcggcgcataggttttaagcgcatctatcataatatcccttccgtccctgtattcccggcggatcagggagagatatttttccatttccccgctggcaataaagcgttccacgatcagctgggaaatgcagctggaatgcagatccatcagctggcggatattggacagcctgtaaatcagctttttattcgcccagatccagcccagccgcagcccgggataaacggtcttggaaaaggtgctcaggtatatgacataaccgctcttatccatggattttagcggggtcattgtctgtccctcatagcacagctcactgtaaggatcatcctccagcaccggcaccccgtatttatttatcagctccaggaaacggatgcgcttggaggtgctcatggaaacgccgcagggattatggtaagccggcatcgtgtaaatcagctttggccggtacctggtcagcagctgctccagcacatccacattcatcccgtcctcttccatgggtatcgccatcagcctcgcccccagggagcggaaggcctggatcgccggaaaaaaggagggttcttcaataaacacgatatcccccgggttgataaaggccctcgccaccagatcgatgccctgctgcgccccggaaactatcatgatttccgaaggctggcagaagcaggaacgcttctgcatgtaagagctcatcaccctgcgaaaagaggaaaaacctgccaccggtgaaacaagcatgctgctctgcctttcaagcagctcctccccaatgccttcaaaggcctgtatgggcggattctcaaaggaggcaatacctgctgcaaaggaaatcacatcctttctgttggctatttccaggtatttattcacatcgaagccgtcactgtttttcagataatcactgaacaggtgatcccagatgggttccccgggataaaccgctttcaccggttcctcaccgcacgcccggacggcaatcgtcccccgtcccacatgggacgccatcagtccgtccgctttcagctccttataggcgttcagcaccgtggtgcggtttacgcccagcgcctccgccagctggcgttcggaggggaactggtagccctccggaatttccccggaggtgatctgcgcccggatttgttctacgatctgctggtaaagcggtaatttttttgatttgtctatctgaagcttcatagatattctcatctgcctttatttttattggttggatccaattttattttatacgtatgattttattggttcaacatccaatttggtttatttttatacagccaatattaaaggagattttttctatgattctctcagattacccgatattacagcttttccgccattctacttttagtcggtagcatttttaagcaccctttcgtataatgagggagcagacaaaggagggtacaatggaaccgaaagacatgggaaacaaaattaaaaatgcccgtatggcaaaaggaatgacacagaaggaactggcctcccaagttcatgttacggacaaggccgtttccaaatgggaacgcggagtttcccatagttaaagataccacaccaaatataacgaatccacgcttatatgatactgcatgaaaaaaggtacttgataaaagcaatgaagcgcaatatcaagtacctttttgatttgttttttacatggttattaagagaattactcttattccgaagtcctcaatcgttccaccacagttcctttgttaaagaagtggagaacgatcagcggaatgaccgcagccagcaacagataaagcacgccgatgaccaaagctggaaccaatgtaatgtgcagagtaaagaaccacatagatggcgagttcaagacatttttcagcaccgtcacagcaagcagcagcgcaaccactccaccaatgatgtctgcaccagcggcatagtaaacgccttcataaaccatcagcctttgaagctggcgatttgtcataccgatactctgcatagtcgcaaactcatggcgacgggtaataatattggtgatgatcatatttgtaaagttaatcaatcctgccaatgccatgatacagccaatcagactacctacaacccaaaccatacttgcaacagaatttaattgttctttcagtaattttgttgaggtataggtaacagaggggttcttttcaacataactgctcagaaagtcctccatttgcggatgcagagaagcatccatattaaatccatagttcaacagggtcggggtcgtgtaaatctgtttgaatacggtgtctggtaaatacacaaaaggcgcatcgccgccaatatgcatcgtagccgtagttgttgtcggcgtttcgtcctcagtcccaacggtgcaggcttttgccagaattgtgcaggttttgactaactcaccatccctgtaaaaagaaatgctatcaccgatctgcaactgctctgacagggatgttgttttcgggccaccactcagtcggtctaatcggtttccgataatgacatattctccggttagcattttctgtttcagtacattaggatctgtttcaccatcataaatcatcatgtcagaccaaaaatgttcggaagcgccatagacatttccaaagaaaagattttctgcatccggggcagtattcagcgcataattcccgaaagacttgctaatcccattttcatattcaaaagtatttgtgcaagtaagtccctcaaagccgtaatccacaagcacgttaccgtcatctacggtgttacggtaaagataccgttcttcttccagaccgttctgctcacggatcatatctactacttgctgtggaagtgcatcttcgtgatgtctaaagccctcctgaacattgactgcaatcgaattgtagacggtaaaatctgtttttgttgtgcgggtaatccacttttcttcatccatactctgtgtcacgatgataatagagttgaacagaacgatacacaaaagcatagaaacaacaatgaatacacaacggcgtctgttacgtcctaagttagaaaatgccatgtgagagagctttgctccactgattcgtgtaaccgttttctttttataatcatcctgctccgtataacgaattgcctccatgggagatacttttgatgcctttttggccggtttgcgggtactgataaacactgtcaaaatcgtaaacaatgcggctataacaaatagcataggagatgccgatgcctgcaaacttgccgtagaatactcataactgaaaattcgcattactaccggaagcaacgccctgcctgcaaagaacccggcaattaaaccgatcggcagaccgattagggtcagccataccgtctgccgattgacgatgcttttaatttgccgtgtagaagtaccaatcatcctcaataagccatattgccgaacatcctgcataacggaaatatcaaaaatattataaatcagcagatagccgcacaatacaaacatcagcacaaatactacggcaaataagatggactccggagaaatcatggcttttcccatctggttttcaacagagaggataaagttatccgcagacatatcctttggattgcccccgatggagtagacaaagtcatccatctgcttctgaatgttcgtcttgtctttcagcacaacatcagaaaaagtaacccctgagatttctccatccactgcgcgggtatttttcaccacatccggattatcttttacaaactgctccgaaaaaacggccacactgaccatatcgttgcttgcttcccaccagccggaaagcaccatatcataatgataagtttttccacgcagttcaaattccagcggaacttctgctccgatctccggctccacaccaagggctttcaaagccagttcggtagtagcaatttcattcgccttttccggcgctgaaccatgcgttggcacacagaatgtaagttcctgctgtatgctgtccgcatagtttaattcaacagaatgacccacggcgttgcttgcatagccaatcgtccgccgatgacctgcctgctccacaaaatcactgtttttcagttgctcaaactgttcctctgtcatgtacccaaaggttccatctgccttactgcctttctgcatctgcatagagagctgcatggaggataccatgttaaatgccagtgaagtgatggatgtaaacaaaaatgctgtcagaacgattgcaagaatcgccgccagattacgaaccttattcttcttgaaatattgtttagacaggtgcttgatggttttggtattattgttgccaaatagaatatcgctcatgtcatctccccctttactgcataattctgccatcctcaatccgaataatgcggtcggcaagctgggcgatttcattgttatgggtaatcattacaagtgtctggtggaacttctggctggttactttcagaagccccagcacatcactgctagtcttactgtccagattgccggtcggttcgtcggccaagacgatagcgggctttgataccaaggcgcgggcaatggctacacgctgctgctgaccgccggagagattgtttggcatattgttcagcttatcctccagccccagtatctgaacgacttctttcataaacttcttgtctatcttgtttccgtccagctccacgggtaacacaatattttcgtaaacattcaacaccggaaccagattgtagttctggaagatgaagccgatctttcgcctgcggaagatagtaagctgctcgtctttcaatgtagagaggtcgcgcccatccacaatgaccttgccggaagtaggcacatccagcccgccgatcatgtttagcagagtggatttgccgctgccggaggttccaacaattgctacaaattccccctgctcaacagagaggttcacaccatccagggcctttgtgatattcggctttgcaccgtagtattttttcagttcagtcgtttgcaaaatgctcataaagaacaccatcctttctttttgataaatccattataacgaccaaacctcacagaaatgtcacagccagcataataaattgccctgaaatgtcacaatcctgtgacatttcaaaaaaacaggttattcatggggaagaaaaacggagaatgttgaacctgttcctacttgagaagttacttgtatataaccgttctgtaagctaataatttcccttgcaagatacaacccaatgccgattccctctatatcgtggacatcttcttcccgataaaagcgcctaaaaattgctccttgctggttttcgggaatacctttgccggtatcggtaatgctgactttcaggtgcatttcccagctttcaacgcaaacacgaatagaaccgtactccggcgtgtacttaactgcattatccaatatgttaaataaggcttctgctgtccatttgcggtcatgggaaacaaccaatgtttccgggcagtttacttcaacttgtatgtgctttctttcagcgttcagaaaaataccgcccagcgccatagcaagagtatcatagataggctgctgtttcttttcaagtgagataacgccagtttcaagtcgggaagtttttatcatagcctgcattaagaaatccagtttatcaagctgtgtgccactggcaagtagaaattcccgctgtttatccggtggcacttcttgttctaataaggtggcatttatcatttttaagtttgctatcggtgtctttacctgatgagaaatatcggaaattaactcctgtaagtcagctcgttcactggcaacgctgtttttgctttcctgcataacctcataaagacgcaccagccgatgattgattttataaaataggttttcttcttcggcaacctgtgatacatctatttttccattcatcatttcgtctaaggtgcagcaaagcatttcagaaaacaaagtcagctttcgccgtatcagtatcacaaaagcagtaacacaaagtagaaaaagcagaccaaaagccatgctacaaaataccacagacatttctttggtcaggatatatagaaccgaaaacatgaccactgataaaagtaaaatggtagttgccagtattatgcagactttatttaaggagagtttttttgaaatcatttttgcgctcctccaatccacatatagcccataccgtaaacggttttgatgtaggaatgctggttcgtttcaattttactgcggatgcggctgatcgttgtggttagtgcgtgttcatccacataattttcatctacatcccacagcttttcaagcaatacctgacgtgtcaggacagtttgagaatttcttgtcagcacttttaataaacgatattccaacgatgtaagggtaatcggctgtcctgcgagacaggctgataattcggaaaaattgatatacaaattcccgtcatcgtagaaatcgccgccggattgtgctgaaatgcggttcagtaaagcagatactttcttttggaacacgctgataggaaagggctttgttacataatcatctgcgcccaattcaaatcctttcagcatatcgctttccatatcatttgcggttagaaaaatcacggcggtatcaggacggcgttcttttacctcatggcatatatcaaacccgttcccatctggcagattgacatccaaaacgattaaatcataatcctgtttttcaagaaatcttatggcaacagcctttgacatagccccatccacggaatatccgacagccgacagattatagcttaatgtcttattcaaaagctggtcatcttcaacaaccagtattcgcatagtatcacatcctttttctttttatagtatcagcaaaatgtcacagaaacctcacaacgagaaaaaatttaatattctgtcagttccacaattacattactttgcagatacagccagtccgtaaattctttcgggctggccgttcctgtttttacagccttttttctctgtaaggcttctttcttaaagtcggaaaaggaagcctgtattttttccagacggtcagccggaaagcctgcggtattttttacccggtttattttgttgcgccagttctggcattcatttttataaagcaggtcatagttattttctcttgacctctcgtcaaattcccgcttgttttgaagcgcctgtgcttttcggcacttgtcgctgcacagctcataccgctggctctttgccagaaaatattttccacagaccttgcaccgccggaagcaaagcccccagtcattcagcctgttcagataataggtaatcaacgggtagagggacgcataggcagacacacattcttctgtgcgccggttgtccgggaaccagaggtcaagccgggtatcttctgacggtgcgcctttgaaataaaggctgccagcttgaaattgtttcggttttcctgtctccctgtcaaagctcatggtttcgttttggaataccccggtcagtctgctcattttatccatgaagcggtcacaggcagcgttacggtcacggggttctctggcaagcagatagctgttccagatacggaacgccacatacattttcagagggtcgttgctaagatatttctcccaaagaaattcgcttgccgccagctccagctccggctgtttccatcggttggagtggagagcttgccgcagcggagaaagcccgtataagttccagtctctgtccgtgtcacgctcaaagtttatcaaaaaagttcccagtgggcgtgtcatatcacaaagcacctctgcgttttggctcccgttcagacggaagcggatctgctgttcttccccaatcaaaatccgctctttcattttcttcctgtccagcgtcaggacaaacaaaatcctctcaaaacatggctcatgccgtataaactgattctccatccctatcccctgcctttgtttatggtaattatataattcagttatatccgttacactcatggtatcgcagaatcattgttttgtcaaggatagtacgctatgatgattgcggttggtaatttcgtaccgcacagtaccttgacaagtgaatgaccgtccaaaagggatatgaccggcaggagaagtgacgcattcggcgcaccaatgcagggaaacaccgcaggaatggggcaggaaaacggcttttggggagaacggcaacaggaagcattttaacctatttgatttatgggaggaacagaatgaacgataaaaagagattgaacagctacgaggatttaccgctggttctggatgtggcggacattcagcggattatgggaatttcaagagcgagcgcctatgagctggtacacacacccggctttccagcgttccgcaggggcagacttatcaaggtcagcaaaattgctttctttgaatggatggcaaaaggctccgaaaccgtaccgggaagcgacaaataagcgtgaggtatcattccctgacttgcaatactgccgcactttccaaaggggcatacagagggaaaaaaacttaaaaatgataccgagacgctacatcaaaacagcctatctgcgtacatcagatagaaacggagaaaggagccggttatggcaagaatgagtaacaagcggcggttggaatggtctttcttcttaaatgaccgcagccgtatcacttacaacgaactgtgccggaaatgccagcacgaatgtaaacagagcttccgggcggttgtggttgactgcccgaagtatctttccaagcgttccaagaaaaaggacaagactgccggaaacggcaaaatcccttaggaactaagggcgcacttctatacatagtctaaagaccatgtatcgtgcgtcctgcggagcttacctctgccgctgataaaatcagcaatccgaggtctgcgttcgcttcgctccgacaaggtggctacacccccttgcgccgctaaagcggctatcccctgtgtacccgccgcaaagagaaatccgctctgcggttttcccttttcatcgggttttatagaagcactgacacacggactgtctgcggatggtctttctttatcttatcagcaaaggatgtgagaacatggaaaaatctttggaacagttgaagcaggaatatgaaaaaaccactgtcctgctggaacaggaaaaacggaaaatgcagcgtttgaaaaaccggcaggcgtatctggaaagcggttcccggaaacagaggacgcaccggctgattacccgtggggcagctattgagagcattgcaccacagacaaaggagctatccgaagcggaattttattccctcatggaaagcattttgaatctgccgcaggcggagcatttcatccggtctgccacagagaaccacgcccgtatttccgggcaggagaaaggcggtgactaaggatagcactttatcatttttcaatcgcacagatcaagcgcagcgccggtcagagcgccattgccagcgcagcctatcgagccggggagcgtctttacagcagctactatggagaagtcagcgactacaccaaaaagggcggcgtgatcgcttcggaaatcatgctgccgccccatgcgccggaaatatatcttgaccgggcgaccctctggaatgctgtggagaactgcgagaaacatccaaaagcacagcttgcctattcctttgatattgccatgcagaatgaattgacgctggaagaaaacatggagctggcgaggaagttcgtacaggagcagtttgtgacaaaaggcatgattgccgaccttgcttttcacagcccggagaaagaggacggcggcatccctaacccgcattttcatgtgatgacaaccatgcgccctttgaacccggatggcacatggggacaaaaacagcgtcgggaatatcttcttgatgaagatggaaaccgaatccgggataaaaacggcgattatatgtttaacgctgtccatacaacagactggcatgagccggaaacgctggaacactggcgggagcagtgggcggctgccgttaatacaaaatttgaggaaaaagggctggatgtgcgtatcgaccaccgttcctatgtgcggcaggggcttgacctgatacctactgtccacgagggagctaatgtccggcagatggaagcaaagggcatccgcaccgagaaaggggaactgaaccgctggattaaagccaccaaccggctcatgcaggatgtgaggaagaagatcaaagccctgtttgtctggatggcagaggtaaaagaagaactttccaaaccgcagacaccgagccttgccgacctgttgatcgcttattacaaccagcgcaacgcaggggcatggagcaataaagccagaaccggaaacttaaagcagtttgccgaagccgtcaattatctgacggaaaacaagctgctcacattagaggatttgcaggagcgtctttcctctgtcagtgaagaatttgaagcattaagcggctccatgaaaaagaaatctgcccggataaaggaattgcaggaattgatacgggagggcgagaattaccagcggctaaaacctgtccatacggaattgaacaatatcaagtttaagaaacagagggagaaatttgaaacatcacacgatgcggagttacggctgttttatgccgcccgccgtattctgaaagaaaaactggacggaaaacccattgccctgaaagcatggaaacaggaatacgcacagttaaaaacagagtatgccgaactgtctccgcagcacaagccactccgggaggaagtgatacggctgcggcaggtgcagaacgccgtagataccgcactgcgccggagagagcagccacaggaagtacagagaaagaaacacgagatggagctatgacataaccggcagctttaccgttaccggcatttttatggagggagcatttgaatgtatttgaagcggtgaaacagtctgttaccacccggcaggctgcttcattctatggaatccgggtgggaagaaacggcatggtctgctgtccattccacaatgaccgcacgcccagcatgaaagtggacagccgcttttactgcttcggctgcggggcttccggggatgtgatcgactttgccgctttgctgcatggattggggaaacgggaagctgcggtcaggcttgcggaggacttcggcgtttcctatgagaaatccggcaatgcgccgccagataggaagcgtcacaacaggtcacagccccgacaaaaatcagcggagcagagatttcgggaaacggaacggtattgtttccgggtgctgtgcgattatctgcgcctgctggagcattggaaaacagcatacgccccacagccgcaggatgccatctggcatcctctttttgtggaagcgttgcagaggataagctacacagaataccttttggatattttgttatacggagaaatagaagaaaaagcggcattgatcgccgcacagggaaaggaggtgctgcggcttgaacagcgaatttcagagcttgccgccggaaacgcaggaagcggtcaaaaggacgatggacacaatggaaccggcgcaaacaccggcagaaatccgggaaacattagaggggacgcagaaaggcggtgtgaagaacagcatccgaaactgcctgacggtgttccagcgtgaccctctgtttcgtggggcgctgcgcctgaaccttttgacggagcagattgacattgtgaagccgctgggctgggagcgcaccagtaccacgctgaccgacatggacatgaactacctgcttttgtatctggaagaaaactacgggcttaccagcgagaaaaaggtgcagagcgccatcaagattgttgccaatgaaaaccgctaccatccggtcagggattacctgaacagcctgcaatgggatggcacagagcgcatccgttacgccctgcatcactttctgggagccgatacggacgaatacacttatgaagccttgaaactgttcctgatgggagccatccggcgggtattcagaccggggagcaagtttgaggtcatgctctgtctggttggtggtcagggagccgggaaatctacctttttccggctgctggcaggcagggacgaatggttttcagacgatttgaagaagctggacgatgaaaatgtgtaccgcaagctgcaagggcattggattatcgagatgtcggagatgattgccacagccaacgccaagagtattgaggaaatcaagtcattcttaagccgccagaaagaaacctacaaagtgccgtatgagacacacccggcagaccggctgcggcaatgtgtatttggagggacgaccaaccggcaggactttttgccccgtgaccgcaccggcaaccggcgctttctccccgtgacggtgtacccggaacgggcggaggttcacatactggacgatgaagcggcggcgagggcgtatatcgaacagatgtgggcggaagccatgacggtttaccgcagtgggaagtataagctgtcattcagcatagaaatgaaccgatacctgaacgcccatcagcaggacttcatgcaggaggacacacaagctggcatgatctacgcctatttggaggactacaccggtgacagggtatgctccaagcagctttatgaggaagcgctggggaacttaaattccccggcagactgggagacacgggcaatctgtgagattatgaataccggcattgcgggcggcatcatacagggctgggcagcctacaaaagcccgaagcggtataagaaatacggttctcaaaaaggctgggagcgtgtcaaccaagctccgccggagggggacggttttcaggaaatcacggaagaagaagcccggcaaatggaactgccattctgaaaatccaccggttaacagtttggttgacgcttcggttgacagccagttgacggggaaaagcctgatatttggggcatttctctcctttgtcaaccatgtcaaccaagaaattaaagaaaaagtaaaaagtaataatagagcgcctatggattgttttcaaagtcttttctgccggttgacacggtttggttgacatggagacagtctgcggctgtacacctgcctgacattcccttgtcgggcatattttatttatggaggtaactgcctatggcaaaaagcaaaaacgagagcaataacaaaaacagcggcaccctgcttaccgaaaaagacggcacccagtattttgtcatggggaaagtccgtatcaaggtatcggagcatttcgcacaggatgggaagccgcttgacagcctgctggaagatgtgatccagcacgctgccgccgcttcctgaaaaaatacggaataacgactgtcaatcagcccacgcttatgatatacttgtaccagcgagtattgtataagcgtgggttgtttcttttagaaggaggatttttaaccgtgaaacaaccatacaatacaacgatttataacactgcactatatttgagattgagccgtgacgatgaattacagggggaaagcggcagtatccagacccagcgcttgatgcttaggcagtatgccgcagagcatgggctgaccgttgtagacgagtacattgacgacggatggagcgggacaaatttcgagcgtccaagtttccaaaggatgattgatgacatcgaggacgggaaaatcaactgcgttgtcacaaaggacttatcccgtctgggaagaaactatatcctgaccggtcagtacacggaaatctatttccccagcaagggagtacgctacattgccatcaatgacaatgtggacaccatcaacggagaaagcgagcttgccccgttcttaaacatcctgaatgaaatgcacgcccgacagaccagcaaaaaggtcaaggctgccatgcacacaagatttgccaatggcgcacactatggagcctatgcaccgctgggctatataaaagacccggacaaaaaagggcatcttctgatcgacccggaaacacgctggattgtagagaagatttttgaccttgccgtacacgggaggggtgccgccagcattacacggattctggtggaggaaaaaatacctacccccggctggctgaactatgaaagatacgggactttcgccaatatctacgccggtgcgcccacagaaaaagcctatgcgtggacgattgcacaggtcaagagcattttgaaagaggaaacctacatcggtcacagtgttcacaacaagcagagcaacatttcattcaagaacaagaaaaaggtgcggaagccgcaggaagaatggtatcgtgtggaaaatacccacgaagccatcatttccgaagaagtgttccaaaaagttcaggagctgattgcaagcagacgtagacgacagaagaatggcacaacgcagatattttccgggctggtaaaatgtgcggactgcggatggtcattggcttatggtgtaaacagccagaacaaaaatccctatgcacactaccattgcagtaagtacggacagggattacgccagtgttccatgcactatatccgctatgatgtactgtatgcctatgtgcttgcaagactgcaatactggtctatgatgatacagaaagacgaggacaagctgctgaaacggctactcaatgccagcgacagggaaagaaactctgcgaagaaaaagcaggctgcggagctgaaaaaggcagagaagcgtaaagccgaggttgacgggctgtttgctaaaatgtatgaggactggtctgccggacgcataaccgagtataacttcaatatgctgtccgagaagtaccagaacgagcaaaaggagcttgaaacaaaaataagacagcttcacgaaacgatggaagccgccgtacagaccgcagcggatgctgaaaagtggattgccctgatgaaacagtatgtcaaccctgtggagctgaccgccgaacttctgaacactctaattgaaaaaataaccgtccacgaagctgtcaagggcgaggacggaagccgtgagcaggaagtagaaatctactaccgcttcatcggcaaaatcgactgacctttcttttttacccaacaatatctttaattaagggagacgggactctgctttcctgatatgagcaacctggagccgctggccgacgctctgggtatgaaaatgacagagctttttatagacagctctgtaaacgaatccgaagaagaaaaggcggaaacctctttaaaagaggcggtacagcttgtaaaggcaaggcagaagaaacagcgccgtgacattattctggcatttgctggcatgttcctgtttgagctgctggccttcatggccatatgcttttttttagttaccgatctttttgtggaaaaagacaaggcggaacggattgaagattatgatacctatatggcagttcccgatgcccgccataatccctttgcaccacatggaatggtggaatggattttcccccggtcgatcccggagggcgcccatgtaaatgatttctattatgaatattataatccctgggatcccaattacgtcatctatctggacgtcacctatgacggagacgcctatgagaaggaacgggaccgaatttccacaaaatgcggcatgcctctggatcagacacggtatctggtgtacggggccgagggcttctactaccctgttttatccgcttcaggaggttcctcaggcatcctgtatgcgctgactgatgaaaaggcccgccgtattatgtatgtggaaatcgctttctgcaactatttctccgatattgactatgaaccgattatccctccggaaattcttcccgcgggctttgacgccggtaaaaataacccgacaaggcggaaattcgtggtggaacaggaagggctgcgcatttacaacgcagccccttcctgacttttcctattttaccagttcccttatcacctcgggcgcagtctcctgctccggcaggaattcctccgatatctatatacctgtaaacagcagcctgcagtgcctttaaaaagcataggaggataactcccgcacagtatagggctgggtgtgagggttaagctgcgggatgccgcagcccttcgcgcggcccggcagcaaggtgcagcagcatttcactccggtctggcctccccgtacttttgggcacagcccggccgcccggaaatttatatttatccttcccgtgtcgccgatactgccagcagcagcgccgttgtggtctggttcatgcttccgtcataaatctcttcgtccagcataaccgcatccttatagggcgtcacattctgcagcacatttccgtccgcatccagcatctgtatccggtaagaatacccgattctttgctgcaacgcttcctcaggccgtatgtccagcgccgcgtaggcttccagaatctgctccttctcttcctgagtgcccaccataaaaaccgtgccggtatttccgtttgtcacccggatatcggccacctcttccaccggcaccagaacctcccgcacatcaaatccggctgcttcttccccatttgcttccgcattcacaccataaacgccttccgcaggatctgcaagcctgaagcagtccttccccgcagtttccgggtcctcgtaaatgacccggaatgccacatcctttcccggataacccggttcgggaaaaacactgttcataataccaacaccgacatagagataaatctgatctcctaacgcatatcttatatggctgccgtaactgactcccccaaatcctgcatcttcattatcctccagcttatatgataatccgccaaagataacccttccggtttcccgctccgtaatgtccacggtcttttttgccgtatccacacgataatccagcagcctgccgatttcctcctccagcttttcaccgctcagctcataaggatccatatgcgcggtatcataagtttcaaataccaggagcttttccagatacagccccgttccgcttcctaccaaaaaagcaagcgccgcctcgtcccttccatctccgtcataatccccggcagaaagcttcgggccgtcatacaaattcacccactccgcatccacttcattaatgttgtccattccatccagacggaaattcatgtaaatgccccgataaccgtattccgggctgacacagccgtatgcctcataaagcccgtcctctgttgcggccagccgtaccatataatccccgtcctccggaaccacatcaccaaaggaaagcatcctccggctcttccagcaattttcaaataccctgcccatcacctcatgaatatcgggcagtaccgtatcttcccggctcccctcctgtgacatggaagactctggctgaccatcctcagtacggttcacagttccggccgtttcctccgttccgtttattcctgcgctgtttatttctgtgccgtttatttctgctttgtctgtccccgtcccattggtcaggcatacggcggcgataacaagaatcataagtgttcccccaacggcagcccatacgcctggcttacggaaaccaaggatattttttacacggctttttgcatccttttccccaaaagaaaggggaccggcgggatgcagccgtctgttggatgcaaaggaaagcagcgaaaggctgtattcctttttgattccgcttcccatctccaccagaacgtgctcatcacagctcatctccatatcccgccccatgcagaaaaaagcaagccacacaaacggatggaaccagtatacggcggccaggaagaatgccagtgccttgacgtaaacatcttttcttctgatatgaaactcttcatggcggataatatactcccgttcccgttcactcaggcggaaaggaaggtaaatccttggccggaacagccccaggacaaagggtgaactgatattgccgcattcataaacattgtcctgaaggcggaccgccatatgtaccgtccttctgagccgcagccagcaaaacaggctgtataaaagaatcgttgccagcccggccagccaaacccacgacgctatatgcagcaaatctgccgcgctcacacttcctcctgtgatgccgtccagaaccttctgcatcataccttcagccgcaccggccggtatatttccggcggcatttcctgccgcgccggctatatccacaccggctgtacccgcagccacagttccccctacgtttaatgcgtttgccgcagctcctgctccctgtgccattccctgcgccccggaagccaggccggcaccggctctctttgcaactcccgcagcacttcctcccgcggtaagccattccaccgccgctgcaatccccgcagccttccgcccgataaaatcaacattaaacaggctgaatgcggaagaaaccgaaaccgggcatatcagccggagcgccggaaccgcccacagataataggagtatttcttaggaagccgcagcctttgaaacaacagccggacggccagtaccacaaggatcacccaggatgccgtcattcccatggagatcagctgtgaaaacaatccgcttgccataaacaatccctcctattcctctttatgtgcatcgattaatgccttaatgctttccgcttctttttccgaaagcgttttccccccaaggaaagcggccacaaactggggcagggagcctccaaaggtacgctccacaaaatattccgtttcctccttctgtacccgctcccttgggatcacaacggaaaccaccgcattttcattggtaatatagcccttatcacaaagcttttttattgccgtataagtggttgattttttccaacccagctgacctgcgcacagttttaccagttctcctgaattcaccggcgcatgctcccatacaatcagcataaaacgataatcactgtcacataacttcagatactccataaaaaatcctccctgatataataagtcggtggttatagaccttcttttctttagtctataaccaccgacctgttttgtcaatcagtttctgaagtatttacctgaagaaactgcctgcctttaataattcattatataacaacaaagaggatatcgtttaggatatcccccttgccctgttacatattcatcgttcccatccgaggccttttcaccgaaatccgcaaaagtttcaatacgtttactcttactgccaaaatcaatactttcctgtactgtcagcggaaggcgaaaggattgccctggggctgtagcaattccggaattcctcttttgcggccttcgaatacttttcaacaaacttcagtttcgcttccgaatagccattgggccttccgtctacaatgcgccgtattttcccactttcaatatcgctcagtatattttccttcagcttcccgtattccgccgccacatcaggatgcgcaatcaggtaatccctaaaatataactcatcccagttccccaggtatctcacatggagatggaaaaccttttcttcatacccatcaatggaatagcctttcccaagcagtaatttcatcgggtcatcccaccggataaaaattgcctccccatatccaatcgcctttaaagcatcaaccagcctggttacgttacatctgccatcaatctcaagcagcatatctattgtaggtttcgctataacaccttcgacagcgctgctcccaatatggttcatccgcacaacatcctcggcatttacagcatctaaaataattttcttctcgctttcataccagtctttgtaacttgtattgtactcctttaaaatgattgggaacgttttcttaaattcgtccgccgacagttcggatactttcttagccatagctgacactccttgtctgttataaaaaatcgcgctgttgatttaatggttaaatcataacataaccgttccggagtttccacttcggttttcggttatttccgaaacaaattatcattccgtaactttcccaagaatgataaagggaaaaaatttatatcatcacgcattctgcagaacctcaattgcatattgtcacaatcccgcacaattttaatttaaaataaaatgcaccactccgcagtcatactgcgcccagatcccatgtctcgcctcatccccggacctcactctgtccaccgcaaaacggccctcctcaaaatgcccttcctccaggcaaaggaactccatattgtgagccagatgctgtccgttcagccagttaaccggtatcgatccatcctccggctccgcaccggtaaaaaacagtcttaccttatgccccaccagataaaattcattctccgccatacaaaacagcattcctcttgccgtctcctcagccaggctggccggaagacggttcagtccctccaaatcccggttatgatggtaatcaagcggcacccagccagcataatccgttcccacacccgcaaaggaaacccggcatctgcggccagcgatttccatgtactgtgagtcctgccccaggctctggcagaaaacagcagtctgccgcaccctgccatcatacaacagctccgatgccgccttcagcatggcaaaggaatgcatgatcgggacagcggaagccttcagctccccactctcatccagacagctttctatgccgaacacatgatatccaacggccttgtgctcacccaccgcgccaaacatacacgcagcgttcacgcttgtcagccccgattccggcacataaagcggccagcctttttccttcccgtcataaatgtcataggctttgcgtaccgtgtccgggttcatctcgtaaatatccgggcacagggcatccagatggccgcatacacactgccacagcggcagacatttggaaaccgcccctccgcagggatattccagcccggccagattccagccgtgcatgctattcctgtccatccacacattggtatacatgaaaatatccctgaccgctttccctctggccgcgatttcatcgatataggaagcaatcgcccatgccgtacaaagctctgcgccgaaggcgccaaacatttccttccagcttcccgtgctgacaccgccgtttttcagccagctttcatgtatggcgcccgcatcctgcgactgcgccagcagtctgatagcctccggcacctccctggaaaaagcagccgtcccctgctcactgaaatccctcctggtcgcagcaaaaatacccggttcattttccacctgaaccgctataatggtttctcttttttcatcataatctttcagaatcttcatcagctcacagaaagcttccgcatctttttccaggttattcctgctgtgaggggaaagcaccgtggtttccgtgccgtccttacacctcaccctcggaaaacgttcccgatccttcttcacccaggccggcgtgtattccatctgcccgtttttccaggtgccgaaccataacaggattccatgcagtccatggctgcggacagcatcaataatcgcatggacgtagccggtattatacacgccctcctccggctcaaacgcatcccagcagacagggaccgctatcgtatttcccccgattgccctgacgctttggaacgacctttccgcatcctcccctgcttttccttccccgatccctccaatcggataggaagaagaattatgtacctgtcctcccaatgaaaaaaatggtttccccgaaaccgtaaaacatgaatgtctcatattgcccctcctttttctgccgctctttcaacggcccccaatcttcgttacaatctctttaaatcatcttaaccaaactccacttcccattattacagtgctctccgcagttcctcccatcccggcgcaaaggctttttcactcccccccggcaaaacaggacacccaagcgccgccagcattgcatagccctcccctgcggcatccatcataagatccagctgtttcccccttattttcgtcagatcacagtccagcgcatagcagacaaagcatatcggcaggataaacgccaggtggcttttataccagccatccatatctgaaaacataaaccggctgatattttcccgtaaaaatgctggaaaacacagctttcgtcccttcatccggcatacagtgcaaaaaaccgcaggataaatgtgtgataccgaaacgcacgtagattacctcgccctcttccttacgccgcgtgccaacaccgttacctcacgaccatttttacataatacatggcacagataactgccgacaccccctgcaccgataactataattttcatgccggatacacccccctttctcctgacagccgcctgtgaatctcttttcccggctataacgttagctacttctaactaagagtaacacactggcaggaacaatacaatgcagcacaagggatgagacagtttacaagcataataataagcgaataccatgcatcaatgacacgcgccttgacaaggcctgatacatcttctatagtacaaatattaccggccgggggacaggccgctgaatacacggagcaactaccaacctccaaaacagccggtcttaagcccggcattctgctccgataccgccacttagcaacattcgcccttttatcaatgatatcgccgcccgctaaactcacaatcacaggaggaatccgccatgaagcacatgataagacttaccaaccacacagcaacggatattatggatatctttcacatcgcagatgaaatccggcagggaaaacatgcagatatcctgaagggaaaaagtattgtcatgttttttcccgaaacaagcatccgcacaagagttacctttgaaaaaggcatctccctgctgggcggccagcccatcctgttcccgcctgaagccctggataaaaaagaggcgctgcaggatgtatgcggctatctcagtctttgggccgacgcccttatcgtccggcacaaggatatccgcctccttgaaaaactggcgcagcattccgatatccccatgatcaacgccatgaccgacagcaaccatccctgcgagattatcgcagatatgtatgccctttccaaacggagaaaggatttcctaaaagacagctacctgttctgcggtgaaaacggcaacatcggcctggcatggaaggaagcctcacttgtcatgggctttgatttatcgcagtgctgtccaaagggctgggaaatggagcacattacagcctttgatactattacggaggccatccggggaaaagacatcatatgtacggattccctgcccccggatgctcccgcggccttcaaaaactgccaggtaaccagggcagttatggaaatggccaacaaaggcgccctgctcaatccctgtcctcccttttcccggggcggggaagtctccgccgacgccctggactccgaatacttcgtgggctatgaatttaagaaacacctgcttgaggtacagcaggccatcctcatttactgcctcacaaggtaatcccctcccggggcaaaacagcccgcaccttccggcctacggctgctctcccgacaaaataagctctatcagccgggaagcctcgcttttcgtcagcgtttccggattccagttgatttttatctttttctgtgccgccagcctcgccaggaatgccacctgcttcgggctggcggggaactccgtcctccccttcccgctgcagttcaggggcgccggtttaaaaacctgaggttctctttcttcaaaataatgagcaagcgtctgatacagctttgccgttgccaaagcatcatgatatgcccggtgtgccgccttattgtctatctcataatgggcgcacagggcctccaggcttttcgattccatatttttatggacgcgccgggcaattttcagggtatcaatcccctgcttctcaaaagacagccccaaaagctccgcctggtttttcataaagctgtaatcaaaaattatattatgccccaccagcacttcattcccacagaaatccagaaacgcaggaatcacctcctcccgtctgcgggcatcggccaccatctcattggtaattccggtaatctccgtgattcttgcagaaataggctcgctcggcattatgaattccataaatcgttcctgcaccttcccatcctgcactttcagcgcgccgatttcaataatttcattggtctccgggctcagacctgtggtttccaggtcaaaagcaatatatgattttaacatgtcctctgccgtattcctttccttttcggcaccgcagccgctgcggccacaggccggataagctttatcttcgaaaatttccatccgcattcattataaaatatttttgttaattattctacctcaagcggttctggtacggtttattttttctcaaaaagagctttcaccatagctgctgtatttttccctgctttttgatacaatgaaaagaaaacaggaaagcagcttttgtccggcaaggtggaattatgattgatataggcatgccaacgctcatcgagttacccgaaattgaagactgtgccgcactatgttctaagcttgggctgcagtttgtggagctgaatatgaatctcccccaataccagaccgtcagcttagatactgacagactggaagcagccgcgaagagatacggtatttattttaccatacatttggacgaaaacctgaatgtcagcgatttcaacccgtttgtcgctcaggcctatacccgcacggtattggaaacaatccgtattgcacgcaggctgaatatcccagtgcttaatatgcatctgtccgaaggcgtgtattttacgcttcccgacaggaaaatatttctgtacgagcaatacagggagcaatatttacagagcatccggcttttccgggaaacctgcgagaataatatcggagcgtccaaccttaaaatctgcattgaaaacagcagcggctacacggattttcagcttctggcgctggatctgctgctggaaagcaccgtattcgcgctgacctttgatattggacatgattactgcatcaatcataaggatgagccgataataatcagccgcagagacaggctgcaccattttcatttccacgacgccacggcgggaaaaaatcaccttccccttggcaccggagaaatcgccctgcagaagtatctgcatcttgccctccaatgccgtgcccgcctggttctggaaacgaaaaccgtagaggggatggaaaggtcggtgggatggatgaaagcgcatcttatggatgcttaaaaaagctctgccgctttacagcggacagagcttccatatctaataattgtatcctgcaggcttttgtcattctttcactgcaccaagcataataccgtttacaaagtacttctgtaaaaaaggatacacgaccagcatgggtatcattgcaatgaagatttttgccgcatccagagatttgttggaaagtttatccatcttctcgatctgatccatagacagattggtcgtctgtatgctgaccaccatttgcttgatataggtctgcagcggataatgccgttccccgctggaaagcacaagcccctggaaaaattcattccagtagcccacgctggtgaacagaatcaatgtggcaagaacaggaatcgcacagggaaccacgatccggaatagtattctccactcccctgcaccgtctacctgtgccgcttctatcagctccttcggaatccccctgtaaaaattaatcagcagaatcagattgaaaaccggcaggccgccgcacaataccagtccccatatattatcaatcagtccgtattttaccatggtgatataccagggaatggtccctccgttaaaaagcatacagaaaatgactatccacataatcacgttcttaggcctgtattctgaggccggcttagataacggataggcaaaaataatcagtatcagcatggttacaattgtgcctaggaccgttctttccacggatatcagaaatgaacggaagaactgcgtatcccccataatctgctggtaggaagccagtgaaaagcccacgggataaaaagtaaccaacccggagtttgcagccgatttactggaaacggataaacagaaggcataccagagaggataaatacaggaaacggacagcagcgtcataagaatgacgttaaatacattaaatattctgcttcctattgatttactttggatcatatgtattctcctttacaaatataaattgtattcgcggaccgacggactcagaaaattttataatctgcagccttgtatgcaatgatataggacaccacaatcaggataaaactgattgcggatttaaacaggcctgctgccgtagccagtgagaactgcacattcaataatcccatccggtaaacccaggtatccagaatatctcccgtggaatagacaagtgggctgtacaggttaaatacctgatcgaaacctgcattcaggacattccctaatcccaggacagctaccacgacgatcgtcggcgcaattcccggcagcgtaatatgccacacggccttcagcctgctgcagccgtctatggctgcggcttcatacagatcctggctgacgcctgtcaaagccgccaggtaaataaccgcattatatccaaattccttccatacatcagaaaaaataaccagctgcctgaaatatttttcttccgcaaaccaaatcttaggctccacgccaaaagctgacactatcgtattaaaagccccccggaagctgaacagctccagaaaaatactcgcaaggataacccatgaaaggaaatggggcagataaactaccgtctgaacgatcttcttaaatttcatttttcttatttcattcagaaggagcgcaaatacaagaggtacaattacatttaaaaccagttttgatacggcaataattatggtattcacaataacacgtctgctgtcgctcatcgaaaaaagatattggaaattttccaggccgataaaatcagaccggaaaaaaccttttaccggatcataattttcaaaagccattacaatgcctatcatgggaacaatattaaataaaatcagccagagcattccaacgcccaccatgatattataattcagaaaggttgtggattttcttttcctgccgggcttttgcagatgcataagagcagttttcataagattcctccatgtaaatatttatattgcttctgattgaaagaaggaaggattacagcagggctgcaatccttcttaaagcctattgaagctcggctacttcctgcagaatcgtatctccgccttccgctttccactttttaatgaattcatcataagcgctgatatcggattttccagtgattaccttcataaccatttccttttccatagacagaagattggaccacttgctctccatagttggtgtctggctgaaaacacagctgcgggtcttcttgtcaacagtcgtggtggcataaggcctgtcaccgataagcagggaatacattctctggaaatcaccgaagttctccatgctgaagtcctcaatagaaagctgttttccactctcatagcctggaacaacatcctttaccacggaaacatcgttggccagcagcttgtatgcactggaaataccctgataatcctcgggagaagtttttccatccagtacgttaatcaattcgtgataggtatattcacactcatccgccggagccatcagcgttcttaccggccagaaatccaagggctgctcagatacatcaaatttgctctcgtctctgagcaatacgttagccataataataaccgctttcgccacatcctcagaagcatttttattgattacacaatagccagtggtggcagagcctgcctttacataatatctattatcatccgtataaatgggatatgcctgccagttcgccgtgggatcatttctgtatgcatccccgatgccgtaaccggatacccaccaggctccaaaaaacattccgacctttccggaattaatcagttcgattgtagaatcccttgtccccatttcctgatcgatatatcccttttgataccagtcggccagacgttccagggttgctctcgttgccgcgctatccgttccataagtcacatttccgttctcatccttcaaaaagatacctggataacaatcattagctgaaaatacggcatcgaaaccgcctgtagtagtcgctgtttcctggaaggttgtataacagctggtatttttatcaggaccggcaatcggtattgtatcctcgcctgcaggcttcttttccgcaaatacttttgctatattctctacatcatccaatgttttcggtgcttccagtccacattcatccagccagtcctggcgaatattgataacctgtattcctgctgtctccacttcagttgctggaattgcatactgccggccatccacgctggcttctttgattgcctctccacccgtagattccattacctccttcacttgaggtgactgcatctgctggaacaggtcagtaatatcatacagctgaccacttcttgccgccttcaacatatactccctggaaactgtcattgcatcaggcagcgtattgctggcgatgcaaagcgccaccttctgtgtataatcgttgccgctggctgcagtccaatccactactaccttaatgttgaaattctccagcagataatccgtatactggttattctccacgctcagtccttccggcagcgtatctgtgggactgacgccctgcccgatatgaacctccacaacctccgggaatttctgaaatgcggcttcctgtgaaccggctgtttctgtcgatacggaacctccctcaacctctgaagccggaacatctgcagttcccgcatctgttggctttgaaccgcagcccgcaagcaatgaaaatgtcattgcgcctgcaagtaacatggaaacaagttttttctttttcattgtaaacctccctgtttatgcggagaaaatacgacttctgtacgagcagaggattttctccattattgtgtaaaataaagttactgttgtttttctgtctctattttattatttattttacccatccgtaaccagcaaacgcccccattttatagaacaattgcatagacatatatgtcatttgtaaataattttctaaaaaaacagaacaaatatataaaacagagacgtttgttctttccactgcgaacaaacgtctctgtaaggctgtaacataatacccctgtttattatttcccggcaaaatactgtacaatatacccaatacattatttatcagaaagcgccctcttatactcagaaaacgtaatgccttccctgagctggaatacctttgcaaaatatttttcatcccggtagcctacctgataagacacctcagaaaaggacaggctgtagttttccctgaccattttctttgccagctccactctctccttccggataaaaccattcacagaaaaaccggtatattttttaaagctggtagagaaatagctgcgtgacatgcttatggaatccgccgcatcttcggtttttaattcgttttcggtcagatgctccagaatataatctgcagcaaccagtataaggctctcaatacgctgattattttcctgacggcggatactgtcaatcagcttctccctcatttgcggcatccactccatctgactggcatgaaaatcaaaatcatcctcagaaagatgcacctcaaagctctgggaaacagtacgcaatatatgcagtaaaagtcggtaacgctcgatttcattcagctgtgcagccgccgccctttcccttaagacttccatttcttccctgttataaatacagtgtaatgcactgatttcatcacaaaacccatcaataagctcttttttgctttctctgggagagctttccgccgtcgcccgggaatccatctgtgaagcaatccgccggaagatttccgcacaatcctcctgatccagctgcagcttggaaatatagtcacagacacccagccgcagcgccttttgaatataatcaaagctttcatgcgagctcagaaccacatattttatttccggccttctcagcttacattctcgtataaaatccaacccgcacagcaccggcatcgccagatccacaacggcaagatccacttcattctgttcaatgaaatccagggcaagcgctccattggccacatccccaaccaccgtaaaaccgcactcctcccagggaacaatggatatcaaccctttcctggccagtttatcatcatcaacaatcagcactcgatacatgagcatcacccttcggtaaaataattttaaccacagttccttttccggccgagctttcaatccgcagcttagcccgctccccatacactgcgtccaatgtcattttcagataccgaagccctattcctttatttttccggctttcttccggattttccacctcattctccggagtaagcacgaacccttttccatcatcagtaagcgtaatatgtatctgctccgcttcctgccacacttttacccacagatggccgaactcgtccatattatggcagacggaattttccgcaattggctgaagaatgaagcgcgcgcattcctgatccaggtaatctccttcctccacatccataatatagtcaaaatcataggttgtctgctgcagctccagataattttcaagagcgcgcagctcagtgcgcagggtcgttacataatcaatttttcccagcgaataagacaggatatagcccagccggttcacataggatgaaatatcctctgccttttctgcaattgccatccagcgtaccgtattcagtgcattcattagaaaatggggattgatctggtatttcagtttttccagctccagcaacgacttttccttcatctgctgctggtttttatccatcagtgacttaatctgctgcttcatccggttaaacacttcaaacagatgatcaaattccttcaggttaaagtggtattccgatatttcaaaattaccatcgctgaaatatgccatttcattttccaatgctttaagaggccgggatagcagccaaatctgtgaaaacgtaacaatggcaaggattgcaaaagaaataaatactgcaataaaaatccagatcagccactgattggtctgatgggaatattcattaaatggaagcaaaagaacataagaaaaaccatatctgctgttttccgcaacacctatgtattgattctgattaatcattccttcatcatctaccgcaacggatgtccctacaggaaaattatccgaactgctgtagattacccggttctcagaatccagctgaagaaaagcatacgccgtttcctccagctccgatttattccgcagcgaagaaagcacatccgtcttcgcctccagataaatgacagcctccaaaccgttgctgaacacgatgggccgcattaccgaaaccacatccttattcagaatattattatatgtttcatgtaccggctggaatactatctcatccgtcctgatgagaaccggcaggcccttcggttcgaaatgttcggacaccggaaaactggaaaaaataatttcattagaaccgttatcctgttctttctcagaaaaatagactgaaagcaggatattttcggttccaaaggttgcaatgttcaggctgtttgcaaataaactataatcattaattctgtcatactgtatgcttcccgaaagaaaggaatcatacttttctccaatcagccctgtaggagtcatgttttgtgaaacctgcaatatctcattatattcggaatcaacacggctgataatatcctgaagcgccgcggtgagtgaattttccacacgggaacgctgggcaatcgtccaggaaaaacggattacgataaaaataagaataaggcacagaagaatgcttactataaggatttgtaaaaatctaacctttaaggagtttccagataaaaatttcccccttttgatgggctccttaaaagaactcccctttaagaagttttccttcaagaagctcctgaatcggggttcactgctgttcctgattttatgaaatgtctgtttcccctcattgcgctgcaatatatccccctccatcccctctgtttacggcacagaccttttctttctcaccatattgaggtatgcctgctgccggatacaccgataaatctcatatgacgcctgacagcggattaactgtttttcagtgttttattttttcatttctcctaattttcagaacaattcttttataactttttatgggaattttttatatttctttataaattctataaaagtatagaacattttcagagggaaatcaatccctgctgcagccttgctgctacagtcttactctatctatgttcaggataaacgcataaatttcaccacaatatattaatggtgcaaatatacaaaacaaataatataaaatattacattttcatcttatcgcaaagtaatacagcatttacatatttccctaacaattaatagttaatatataaatgctgtatcgcataaaaacaagaattcattaagaagcatcttcagtattaattgtatactatagaatcagtaatattgtataatgtatactcctcatcatttataattgcataatgagtacaatatactcgataggtttttccaacttcagctttcaagtatactaccgatcccatataataatcagaatcatatgtataatgatctcttattgtaatatccttccaacctaatgttgttttttcttgaagcacaatatctttacaaccgatttctgttgcttctgtagttgctcgagtagtaaatgtaactcctacaccattcttattaatcccaatgcccaaatcacaagaggctaaggattcttctgcaaaaacggtagtttcattttctgaagatgccttaatatcgatttgttcaacaggaatatcaataaaatcagtgctactatctgaagcctccaaattagttggttttgctaatactactccgaccaaaactaatgaaataaatactcttaacctttttttcatcttttctccttactttcgaaaaacttcctcctaatgaattcttcttataattattctaccaatctatagaaaagttacaaaaagcagctatctcccttttaaaggataatagctgccttttgtaatgattataatttaaaattattaatgattcgttttaattctgttatatctacattagtatttacaatataaatctcctgaccatctaaaaaataagcctctaattgttcgttctttttataatactgaaccttaccatcatttgattcatcaactttttcccattcactgtcaaaggacaatatgttctcagaataatctctttcatatatatcgatttctattcgtatataaagttcttgataattatatctcgctattatagcttttttagactccatactatctatacatatattttccattttaaagttttctggcatatactgtggctttaatagttgcttaccaactatactctctatttcattccatccactataatatacagcagatccactcgcatcatcaatcccatccacattcccagtaaccgtaaccttcgtccgcccaacctcgtccctaaccacctcaaagaacgacttcttcttcaaagcataactcccgaaattcactgacaacatcaaaaccaggcaggccgccgcaccggtagcgatccgaaccagcctcctcctccacttcactccgttcttcttaccattttccctggattccataacatcgccattatccggctccctgtcagctccaggctccacatccaacacaatactgtccgtcccgccaaaacgaaccgcagcttcctcctcactgccgcccgcagcttctgcatttacatctgcatctgcggccgccgccatacccatgccgctaccggacgccgcctcttcggcttccgcgtccgcctccgcaaactcctcctccagcccataccggctcttaaacctctcaaacgccgcctccggatccgagggaaacttcggatcatcctccttcggatcaagcacatcaagaagccttacgatagcgtccacctctttatcgtcaaattcctcctcgctggcctcataggtgtaccagtacagcttttcatacagttcctcaattaacttttcatcacgtttcccttttccctgtgtcataacttgtctcctatggaagtaatcagctgaaatgtaagattgcagacactgaataaaaacggcagaagcatactgccgcgtattttctgcttcattctcaaaatcctgaccttaaaacagttctcggtaatccccagcttcttcgccatttcctgcgatgtatacccatattcataatagcaccggagaagctccagctcttcctccgacaggatctcaccgacagtggaataggcctccaccatcttgaaatcatccaccctgctcccgtttcccaacgtagcattatccagaaggaaatcaaaatcaagactgtactttctctgtttttcctcccacttcatcaccttgtttttggcggtgatgcggagccaaccgtggatattcggatgattcaccagttccttccgctttctgtagaattcatagaaggtctcctgcgcaacatcctcaaccgcgttgctgtcggtgagcattcggcggacataccttactatctcatcgaactcttcattatacagttcttcgaaaaactttttgctatcctccattggccctctatcctctttcgtcatattaccttctttcaggtcaaatggtcttctttcctgaagcgccatacatatggccatcaccccgcccctgcctgtcccgtttttcctggaagacacagaacaccctgtccgcagccgcatgtaagtgcctgcactatttatacaattttgtcagattttcaagaatctgctccaggacctgtgtcttatccttgggacaatccttgaaaatctctaccactgttttatcagaagtcagttctcctgttaaaagatacgtaggatccagtcccattctttcataaaccagcaaaattttttctatggaaagccttttatttccacgttcaatctctccataaaaagtcgtggacatttccagaagctccgctgtatcttcctgcgtcatcttcagtttctttctctgcctgcgcagacgttctccgatttcaaccaatacaagtgttgccgccattccgattctccatttccagttttttcctaaggtacgttattatgatactgtgattaagaatggctttttagcaactatatatttgtatttgtcatgaaaaaactactataaattatgatttctcctttaattgtattaaaaaaaaagaagggagcgttatcctctcccttcccgaaaaactctgccgcagtccggattgtcagaagttctttaaatcctctatcagctcatctacgttttcttccagagtagcccaactggtacagaatcttaccgcgctgtgagtttcatccacacgctcctgatagcaatatccatatttttctcccagcttttccagaaccgcatccggaattatggggaaaatctgatttgtcctgttctccaccagcataggatagcctttttccagaaacgcgctgcgcagcttttcggccaggcgaatcgcatgctttgaaatttccatataaagattatcctcaaacagcgtctcaaactggattcccagcagacggccctttgccagcattccacccttctgtttgataaaatagcggaaatcctttttcagttcttcattggctatcaccaccgcttccccgaacagggcgcccaccttggtgcctccaatgtaaaaaacatcacaatgctgcgaaaggaaaggaagatccagctcattgtccggcgccgccagaccgtagcccagccttgccccgtccataaacagatacagtccgtattttctgcagatgctgcttaaatcctcaatttccttcctgctataaagtgtcccatattccgtaggattggatatgtaaaccattttcggctgcaccgtatgctcaaaggaatcatcattgatatgggcaagatacagctgctccacctggccggcatccagcttgccgtccttgtgcgggacagaaagcaccttatgtcccagtgattccaccgccccggtttcatgtacattgatatgtccgctctgtgcggaaaccaccccctgatgggagcgaagagccgcatctataaccgtcatattcgcctgtgtgccgcctaccaggaaatgtaccgccagagtatcgtcacagcaggcctttctgatcagctccgccgcatgccggcaatgggcatcctcaccgtagccgggagtctgctccatattggtttccagcattttttccattaccttcggatgagcgccttcattgtaatcgcattgaaataaaatcatttgtattgtaactccttaattgtcttttttcttcaggactgccagcacataatcccatacccgtttggtggaagaaatgctcagcctttcctcaggcgtatggatatccttcatatccgggccgatggacacacaatccaggccaggcagcttgcccgccaggatgccgcattccaggccggcatgaatggcttcgattctgggctttttcccaaacatctcttcatagatttccaccattttatcacgaagggcagaatcctggcggtattcccatgccggataatccccggaaatctcataggtgccgccctgggattccagaagcaggcataccttgtctataatcatctgtttttcgctcatgacggagctgcggacggaataatccagttccagaacgccatccgccattttcaggatgcccagattcagcgaggtctgtaccagccctttaatatccgcgctcatagcctggattccattgggcatcatgaaaaggagcatttctgcttttttagtgctttcctttgtaaaagcctcccattcgccctgttcttttcctgccacagtaattgaaataccgggatccgtaacggaaaattccctgcgcagaatctcctcaaaggacttcaggctttcctccagtgccgcacactccttctcacaggcaaaaatctgtgcatgggaagcggaagggatcgcattgtccgcactgccgccggccatgtccataaaacggaaatctccgtttttcctgcaaaaatggatcagccttcccagcatggcattggcattagcccttcctttgtcaatctccgcaccggaatggcctcccagcaggccttccacgcctacctggtaccgatagccctgcagcttctgtgtctccactttaaccctgccgtggacccttgcgccgcctgcacagctggtaagcagtacgccttcttcttcgttgtccaggttcagcatcctgcggcctctgcacatggaaagatcaattccattcgccccttccatgcctgtttcctcgtccacggttatgataacctccagacggggatgctcgcagctgtcggaatccagaatagccagcgcataagccaccgcgattccgtcgtcgcctcccagcgtggtatcccgcgccagaagataatctccgtccacctccagatccagcccttcctttgtcatatccttggtacagccgggctttttcaccgcaaccatatccatatgcccctggagaaggatcggctcctgcgattcatagcctgccgaagcttccttaatgatgaccacatttttcagttcatcctgtacatactcaagattccttgccttcgcaaaatccacaagataatcgcttatttgctccacatttcccgaaccgtgaggtatctgactgatttcctcaaaaaaatgaaagacttcctttggctcaagctgactaattttgcccatactctctttactccttttatatgtttccttgtgtaatacctcaaacctataaagcggcctgatagaagtctatcaaaccgcttaacaactccccgagtagggctcgaacctacaacaactcggttaacagccgagtgctctaccattgagctatcgaggactatgaaattaatcagtgatttctctcactagatatgattatagtttccagtattccccttgtcaatagaagatattcactttttcccggttttctttgaaatcatttgcagccctcaccccatcagggcttcgaccgccgtgtccctgcttcccggcctctttttccgccgtcccgtacggacaggctctacatggttttgccgcgtccatcctcccgccaaacccgttccctgttgctctcacggatacgctcctgaaaggtcaggcagggctttctccgttttccctgctctgtaaattttgcggaaaaggcgatgaaaatcatataaatgtagggcattcccagattggtttccagcagggaattcaccacaagcgtagccagctttgcctccagcgtctcaaatcccgcgctgcgtacgccgccgattaaaagccccgcttcccagccgaactgtgccaggattccgatgcccagcaaccagaggacaggcgcttttaacgcagcttcctttcttgtaatgttccatatgacaagacccagatagcccacgatgagaatggcagccatatagccgtggtaggctcccgttgtccgctggatgatcaccggctgctgcgccccgccgaacgccgtggaaatcaaagggcagcagatccaccagccaatcagcagcacggaccattccagcagatttttatccttggaaagccacagccatatccatgtaaaattggtaaaaccaaagctcattgacatccacagcagaacccagaaaaggctgtagccgttttcaatggaacgcgcatggcacagcaggtggaaaatcccataatccaccgccatataaaccagtccgaaaatcagccccaccactaccgtcgtaaacttctttttataaagcagaagccccatgaaaatcaacaggaaaataatatccagccagatataaagaggatcgaactgccgcctcgctataatttctcccatgccgtattcctccgtttttgttatcatacctgccattataccatagcctgacggaataggttacctgatattatataatgcttcttttttcaaagaacaatgcgtgagcagccatggctgtaattaacagagcggcggcatgattttttcataccgccgccgtttcccttcaacaattcttttttcacacttttacaaatacggaggccggctgtttacagcgtgggcaggtaaagccctctggcaaaggcccttcgtgaatatatccgcatacagtacaacgccatttttctattttttcttccttttcctcctgtttctccctgtcgttatcaggcagcagttcaagcagcctttcggcagcttccttcgggaactcctccccaggagggttattaagaagcgactgcagcaggctgtgggtattgccgctctgtggcagcatatagccggcttcccgcaaaatatcctcagccatgagccggttcgattttgctatggcttccgccagctgttttaataccggcgaatccccattttccgcaagctgccgggcaatcctctcctggacggtcttgcttttcaacagcgcatacagggcatcagccacatttttttccttgggctgctggggcgggtattccgtgggaaccatggaaatcgcgcgggacgggcagctttgtgcacagacgccgcacccgatacatttattcacatcaataatactgttctccgtatccgcagccccagtgggacacacatacagacacagacagtccttcgtacataaacggatgtttcttaccgcaatcttcttcatcctgcctgccccctttccacctttgtcattttccagcctggcaccttacatacgggacaaagcgcaggaggcgtatcgcctatgtaaataaaaccacagatatcacaaacataaatatttgtgtgctccagcagcgcatccccttccttttcatacctctgtaaaatggaatttacgatcctgctgaccttttctccccagaccagggcacgcagcgcgcctctgtccggttttactcccgctgcttcgttcgcggcaggataacccgattccaaatcctcctgcagcatggaaagcagtctgcttacatccgcctccggttcttccggagtgatatttttaaaataatcggccagctgcataaacaaggctgtttcttctgataaatattgcttctcgctcccgcgggccagattggaacaaagagcggaaagctctcctgctgtcagctcccgaagctcttccctttcttccccgtcattccccatcttctccgcattcccggacaaaatcgggactttatacgcctcccctgcagctgtttgagccgtttccttcttttctggttcaggcttattcacagcggccgcctgttccctgaattctgactttccggcgccgcacacagggcagacccagccctccggcactgcctcccacgtagtgccgggtgcgattcctccggcaggatagcccgccgcttcgtcgtaaatgtaaccacagaccgtacatacatactttttcacgcctttacctccttctttttatcacctatgcttgtccttctcgttatgataataatatatcagcttccggcttattattctgtgaccaagttacagtaataataataattactattttatttataaaaataaaatgcctttctgcaattggcccctgttccttttgaaaagcatttatcattattggccgtgtttctaatcttaccggcactttttgggctttcttaatcaaaatacacgcctttcaaccttttaaagtcaaaaagcgtgtatttcatttaagcttcatatatcccgtcaccgatagctttcatatagatccttcatatgctcatccatcacttttccggcttcttccgcattccccgcttcgaaagctgccagaatcttctcatgataaaacagcccggcctggtttccccgcttctggacgatttggtcaaacgcacttttcatcacctcatttaaaatgccataaatgcgtatgattacggaattcccggccagctgggctattttcagatgaaattcgtaatccaaccgggcaaactcgggaagataatccctggcctggcgcattctccggaaaatatccgccagctccgctttccctgcatcgtccgcccgtctgcatgcctctttacagaccggcccttcgatcatgctgcgaagctgcagtatttcctccagccccttatcattgatataggccgctgaaaccagagggctcagcatggcagccgcatccgggctgcgtacgaaggatccctctccgaaccgggtctctaaaagctccagcgcagacagcttctgcagggcattgcgcactgtcacgcggctgaccccgaactgctgagccagttcattttccgaggggattttttcccccggcttccattctccctccagaatcagctccttcatctggtcaaaaacctgatcgcttatgctttccctgctgattttataaattgccatagcagtccctttccttacagcagcccggcttttttaagaatcccgcgtattttttccgaatcccccggatccgcttccgggaaaggcagggaagaggcggcgctgccgataattcccttgattgccatcgcttctttaatatagggaataaaaggcgtccccacctggtaaatttccataagcagatcaattttctgctgaatcgctgcagcctcaaccagatcctccctggcaaaagcctccgtccatgcgtggcacagtccgggaaccaggttggacagccctgcaatgcagccgtcgcctcccgccagcacattatgggcaaaattgtcgtcaaacccggaataaacttcaaacgcggggaactcccccttcaccagctttatcagctctctcgtatgatccattccagcctgggtgtccttatagcccacaatattcctgtactttctcaccagccgcagcgtgatttccggcgtcaggtcatagccggtgcgatccgggaaattatacaggtagatggactgctccggaagcgcctccgcaatcctggcataatacgtttccagcccttcagggctcagcgggaaataataaggcggcaggaggatgattgcatccgcgccttcttccccggcaaaacgggacagcgcaagcagttcctcaaaaaccatgcttgtcgtccccacaatcagctgcgttctgtgcgctattttgtccactgcaaaccgtatcagatcctttttctgttccatagtcagcgcaaaaaattccccgatgctgcccagaagcagaatcccgtccacgcctccttcgatcaaatgttcataaacctttccgcagccctcaaaatcgatggttccatccttccccataactgtgactgccggtgtgatataacgtgctttcatctttacctcctgtatatcgcagttctgcctgcgattttcattaatccattgtttgaagaaaacctccgggcttctcctgtctttaaacaaggcgcacaatcagtttcagtaacccgcgcccttcattgccgaggccgcagcctgggtatatcttttcagtacgcccttatagcttttctttttcagcggccagctctttcttctttcgcccaggattgcctggacggcgtccgcctccatacgttctcccgcgatccccacaatatctatcgtctttttctcaatatcataggccagaagatcccctgtttctatgtaggcaatcggcccgccgcaggccgcctcgggagagacatggccgatggctgcgcctcttgtggctccggaaaaacggccgtccgttatcagggaaaccctgccgttcagcctgtggtcacagcagattgcctccgtggtcatcagcatttccggcatgccgctgccccgcgggccttcgtagcggataaccaggatctctcccggattgatttttccttccaccactgcgtcgtgggcatcctcttcacagtcgaaaaccacggcctttccaacatgggagcgcatgcttttttcacaggcggaatatttgactaccgcgccctccggcgccaggctgcccttcagcacagcgatggatcctgtctcctccgcctgctccaaaggaaatattacctcctctgtttcaagcccgtagttatgcagatagccttcccctctttccaggaaatgctctttttgtatttcctccagattttcccccagcgtccttccggttacggtcagtacatccagatccaggtatttttccagaagcagctggactctggggattcctcctgcaaaccagaaggcttcggtaaggtgccggccgctgggattgatattgcctatgtggggaatcgtccggtttatctcattaaacagctcgggatccagttcgattcccagttcccctgcgatggccggcaaatgaagcagcgcattggtggagccgcctatggcgctgtggatgacgatggcgttgcggaatgccgcaggcgtcagtattttatccggccggatatctttttccacaagctccatgattttccgccccgccctccttgccatggaaaggatatcccgcatggtggccggcgccagtgcgctgccgggcagcgcaagccccagcgcctccgccatgcactgcatggtgctcgccgtccccatgaaggtacacgcgccggcggaaggacagcccgtcagcttataatcacggatttcatccggcgtaatctcatttttcctcttctgtctcaaagaaatatcgcccgccacaagagaggtggtctggttcggcccggggcgcatgctgccgcccggaataaaaatggcgggaatattgactctggccaccgccttcagatgcgccggaatggatttgtcacaggaagaggaaagcagcatcccgtcccagggcacaaacccggcatgcatctcgatcatatctgcgatcacttcccttgacgccagcaccagattcatcccgtcgtgtccctgcgcacagccgtcgcaaatatccgtcacatggaactgcgccggatgcccgcccttttcatataccccatacaccgcctgtgtgctcagccctgccagatgtacgctcccgggatggctgtccccataagcgtcctccaccagaatctgcggttttccgatgtcctcctcatcccagccgctacccagctgcagcgcatcaaactgcgcccagccaaaacgttccttttcactgcgtattgccatagtaaccccctttttatccttgtattccgtatgtcttgtatacctgtattacaggtaacttcagattaagcctgccgacggaaaaagtcaagtaccataatgccctgtattcctattgacaattccccctgcaaagtatatagtgtgtattaagttgatacacactgatatttcagaaaggttctcacgatgaaaatattgatttccaacagctccgacctgccgctctaccagcagattaaggatcagctgaaggacgccatcctgcagggagagctgaaggacggggacagcatgccctctatacgccgctttgccaatgacctgggagtcagcgtcctcacgatccgccgtgtttacgatgaactggagcaggaaggcttccttgtgcagcaggtaggagtcggcacctttgtttccgctgccaatgcggaactgctacgggatgccagacgccgtgtggtggagcagaaaatgcaggacgcccttgaatccgcacgcgggctgcacatcccccgggatgagctgcacgccatgctcgatattctttatgatgattttaaaaatacctgacaaaccatattttccatctccggccggccctgccggacggcgctttacgtccctccatcgctttacgtccctccatcctgtgaaaggagctgtctgccatgaaaaatatcatagaagttaacaatctcaccaagaaatatccgggcttcaccctgtcccaggcaagctttaccgtacccgagggctgtatcaccggttttgtgggcgccaacggcgcaggaaaaaccacaacgctgcgtgccatcctcggccttctgcagcctgacagcggagaaatccgtcttttcggcaagccgtgtcccctccatcccggcacagcttccgatttccaaaggaacctgcttgccgaccgcatcggcgtggtgctcggtgccggtgctttttatgaaaacctcaccatccggcagatgaagcaggcaatagcccccgcctacagcagctggcaggaggatgaattccggaagctgtcaaagcgcttcggcctggagccctcccgtaaaatcaaaaccctgtcctcaggcaccaaaatgaagctggcgcttgcgctggccctctcccacaatgcggagctcctaatcatggatgaacccacaggcggcctggatccgcttgtccgtgacacctttctcacccttctgagggagtttatggaaaaaggcggccgcggcgtgcttttttccacacatattacctccgatttggataaatgcgcagacaatattatttttatcgatcatggaaaaattctgctggaggaggataaggacgcgcttctggacagctggcgcctggtcaaaggtgaccgtgcctcactgacaccggaaaaggaaacctttctgcgctgtctgcggattaccgatttcggtttcacagcagtcaccgatcagccggagaaagcaagacagctttttccggaagcactgtttgaccgtgcttgcgtggatgacatcacgattgccctgtgcgaaggccggccggattctttagaaaaccgctgcgtcctgtcacaggaaattacggaaaggaggctgtgaatcagatgaaagcacatatatctctgataaaaaaagacctgttcctcatgggtaactatctttgctttattcctgtttttacactggtgctcccctttttctattattggcggctgccggatttttccctgcagaagggaaccggcctgctcattttaattgtggcttccgtttacagcgagttcctcgcttatgaacagattttcctgaaggatgcggagtatccaaaggcgctctcacttctgtgcgcttcaccctaccgcaggagggatattgtactgtgccggtattttctgttctgcctggttttcattgcaaccgcggttatttacaccatacccgccatgctgctgccctcctccttcctccccacaatgccggaatatgccgtcgcttttttcctgaatacactgttgttctgcatacttacgcctctccagtatcagttcggctttgagaattccaagtttgtcctggtaatcattatcatggcctcctgctttcttctgcccgtactgttgaaaaagaacgcgctccagccggcctggctgcttaccctgccctccgtccctttgttcctggcgctgctttttctgtgtgcagtcctgctgtcggtgtctgccaccgtgacaatatggattttcggcagaaaagaacttatgtgaaaggaagtataccaatgagatacccgttcaaccagctttgttatattgcaggcatcctgatgttttttatgacactgacggaaatcctccgcctgacagtggttctgccccgttcccgccgcactgccgccgtggtgaccaaagtacgtcccgccaaaccggaggatctatcccggcggaaggctgcgggctctggaaaaaagaaggccttacctctcatggcatttgtcacctattccgtggaaggccggaattatttttccggaaatgaaattccggtccctgccggaacccaggtgggagatcaggtgaaaatccgctatgccgtccattttcctgacatgatagtggaacgctccttttccaggctcctgctctttgccgtcttttccctgctttttttcctgcttggttttctggtgtaaatgagatggacaaaaaaacagaagctccttcaagctaaaatgaacgctgataaagctgaaaaaggttactgttcactccgtgaccagtaacctttttcattccatattttttatccggcaatactttttcaggttccgccgttttcagcggacactactgtgcatcccggcttttgcatcacaggaagcttatttggtcaatgcaaccataatatcgttggaacggttaacgaacttggtcatagcctccgcatccagcggtccctgctgcagcttggcaagatcgtaaagctgttcgcaaatcagtgcttcattcttattgtccttgtcgtccttatgcgcaatcacatactctacaaggggatgacttacgttgagcaccagggtttcgccctcgccgccgaacattcccatatccatgccgttcatggcgtacattttcatcatatcctgcattcttctgctctcttcagaaatggtgaggacggaagaaacctttttatttttcagcttctcaacctttacagtcagcttgtcattcttaagcgccttgcggaccagcttctgaagctcctcggactgggcattcagctcttcctgagtcttcttggaggtctttgccttgaaggtatccgtcaaatccgcatcgattctctggaatttgatgccttcattcttcatttccagctgattgatgaagggctggtcaatctggtcaggcagcacgacagcatccatcttggcctgcttgaacatgttcacgtactggctctgcaccttcaggtcggttgcgtagtagatggtcttttccttcttttcctcttctgcgccttctcctgcttcttccccggcagctacttcgtcaacaacctctgcctctaccttttcgccgttttcatcaacagcgctgtcgccttcttccttttcatccggatcaaccttgttgacttccagacagtcaggcagcgtcatgtatttgccgtccaggttcttgaaaaggatataatccgtcatcttctcgcagaacttgtcatccttcaggcagccgaatttaacgaagggactgatgtcatcccagtatttctcatattcttccctgtcggtcttgcacatgccggacagcttgtcggcaaccttcttggtgatgtaatcggaaatcttcttcacgaagccgtcgttctgcagcgcgcttctggaaacgttcagcggcagatcaggacagtcgatgacgccctttaagagcatcaggaattccgggattacctctttgatattatcggcaataaatacctggttattgtaaagcttgatggttccttcgatggactcatattccatattgatcttggggaaatacaggattcccttcagattaaacggatagtccatgttcagatggatccagaacagcggttccttgtaatcctggaaaaccttgcggtaaaattcaatataatcatccttcgtacactcgctgggattcttggtccagagaggatggatatcattcattacaacgggacgcttcttgattttcagcctgacaggcttctcttcagtttcttcgccttccttggcatcctctttcttctcaggctggatggtttccagaacctcatccgtatccagcttctcagcttcatcgatggtctgggtctccggcgtgttttccctggaaaggaaaatctctaccggcatgaaggagcagtacttcttaacaacctcctgtgccttgtattcgttgcagaactggaggcagtcctcgttcaggaacagcgtaatctgtgttcccaccttgtcccaggtgccgtcctccatctcaaattccgtaccgccgtcgcattcccagtgtaccggagctgctccttccttataggaaagcgtatcaatgtgcacttcatcggcaaccataaatgcggaatagaagcccagtccgaaatggccgatgatctgattgtcgtcagatttgtccttatacttttcaataaaatcggttgcgccggagaaggcgatctggttgatgtattcctccacctcatccgctgtcataccaataccattatcaataaatttcagggttttctcttccggattcacgataacctggatttccggcttatagccgtccggtaaggaatactctcccatcacatccagcttctttaatttcgtaatagcgtcgcagccgttggaaatcagttccctgtaaaaaatatcgtggtcagaatacagccatttcttaataatagggaaaatgttttcgctgttaatggacaagctgccatgtttttctgccataattcatcacattcctttctttttttccacggacttttttcttttgtccggttttgctctaggaataagtgtacttcgatctttaaaaaaagtcaatagaaaattagcactcaatttagttgagtgctaacaaaagtatgaaaaatatataaagaaaaaataaactcagcttttatctgctttccctttgtccgaacaagctgggaatatttgaatatcagttctgataaatttgaaccgttactgttatattgtaaaactgcaactgtgagtgtactgaacagttttcgtaaaactaatatattatacaaatttaatttagttgacaaagtcaagcaaacagtatatatttgactttgtcaattaaattatactaactaaaaaggagtcctgtccatgcatccttctttacctcactatatttccctcctgcggaaggattttaccgaatactgcggacagaagctgtccgagcaaggactttcccagggactgttgtattttattctgtatataggaaagcatcccggctgttcccccggcgagctgagccgttcccttcaaatggatgccggccattccacccgttcccttacccgtctggaggaaacaggctttatcctccgccaggcaaatcctgcggataagcgttcctgcattttagagctgacggacaagggacaggatgcctttgacttaagccatgatttgtttgaccgctgggaggcggaggctgtccggggcctgactcaggaagagcacacacagctgcttgccctgctgcgcagaatcctgcccggggaaaggaaggaaccaccatgtatgaaaccataaacagccctgtcacactgggcgggctgaccctgaaaaaccggatcatcttcgcccctacctccatggggctgaaagaggatgaacttcttgcaaaaatggaagccattgccgccggcggctgtgccatgatcatcataggggatgttcccgtgggaaaaaggggcttccattcactttttacccgcaaaggggccgcttactaccgcaggctgacagccgccgcccatgaacatggctgcctgatctgcgcccagctgcatcagtcggactccgactggaagggcatgctgcgttttcttcccggcatccttacaaaacgaatttcccacgagggactgcgccgtctgttgaatgatcaaatatccccttacattaccgcgctccctccggaaaaaatccgcagaatcacctcctccttcggttccgccgccctggaagccaaaaagcttggctttgatatggtccaggtccatggcgacaggatgtgcggcagcttcagctcctccctctacaacaaacgccaggattcctatggcggttcacctgaaaaccgggcgcgctttgcagtggaatgcgtttccgccatccgcagcgcactcccccaatttcccatagattttaaactggccgtgcgcagggaaaacccgcattacggaaacgccggcatcctgcaggaggagcttcccatattcgtgcctctcctggaacaggcaggcgtaaccagcttccatgttacgctggccaaccacggcgctcttaccgacaccattccgccggccagccatccttttttcagccaagaaggctgcttcctggatttctgtgatgcgttgcgcgggctgaccgcactccccctctgcggcgtgggcggcctggtccatccttcttttatcgaagaacagcttcagaagcacaggatcgactgcgccgccatgagccgccagctcatcgcagatccggattgggtgaaaaaggtgcgggaaggcagggaggatgccatccactactgtatccgctgtaatcaggaatgcctgggcggcatgcagcagcaccggggtgtccactgtatttatgacggtcaaataccctgttgcaagtaacagagtataagcttgcagcgccgcagagctacaggcatttgccccgccgcagtcaccggatatccatacaggcatggccgccttgctcgttgcccgctgaaaaaaatgcctgtaaaaacattgcgttttaaacgtcaacgcatcacaatgccgtataagagcataggggaaaccgctccggcagaaaggaaagaatcatgaaatattccgttgtattcagcagccgcacaggcaacaccgcacagctggcacaggccgtcctggccgcgcttcctccggaggactgtatttattccggcagccttgatgaactaatgcaggcaggagaggcttccggctggcaggaagcccaatatctgctggcaggcttctggaccgataaaggtagctgtgatgaaaaaataaccgcattccttcagggaatccatcataaaaaggtctttcttttcggaaccgcgggctttggaggaagcgatgcctacttttcccggatccttgaaaatgtaagcgcacagcttcctgatgacaatacgctccttggaacctacatgtgccaggggaaaatgcctgctgccgtaaaagagcgctatgaagccatgctggaaaaagctcctgacaatgaaagggccgccgccttcctcgctaatttcagccaggcgctgtcccatcctgatgcagacgacctggaaaagcttcagatgcgtatccgtgatatttttacagaacagaaggcttaggcttacaggcgcaaatatcataaaataaagtgtgcaggcaatcaatcgcctgcacactttattttacactctccttcatttaacaatcccagggacagtcacagcctctgcagcagagctccaatcactgtcaggcaattatggagtactgcagaaattcatatttcagcctggtcccttcatccgtttccggcggcagaagcgccctggctaccagcttaatttcatcagattcctcgtccgtccttttcagattggcataatcgccgtccagactcaccaccatatattcaaacgtattcatccctgtcctgcttcctttccttatacagccggaaactacggctgcgaaaaatattttttataaatttcaaaaaaactgcttgtagtcaccgcgtcgtcatgaatcatgtttacagaatcccacagcggttcgttcagattctttgccagggagttcacaaaactgtcgtattcctgcccgaaaacctcatccttgcgcttttccacgattttcagcttgttcctatccgtttcctcccggttgaaggtattgatgcacttgatgatctcatacccctccgcagtctccacaatcccgctgatttcatccgtccccagattaaaagcggcggtttcaaaggccatttcccgttcgcccttgccgaaggatatcgttccctggggatcgtcactgtatttttcaatgagtgcttcgaaggcctctccctccgatgccgcagccagcacctcctgggccctgcggtagcattttgccttttccgcgtccgaaaaagcagaaattgtaccatccgcattttccgtaaccgttttgatcaggatatgctgcaccgtgatatttctggcctcgtcatcgctgatttccggattaatgtcgctgataatctgacggtacaccttgtccgccagagcataatcacggtacatcccctcaatcagctggctcgtaacccccatggcgctgcgctccgtttcattcagggactcataatactcgccggcggcctgcacagccaactcctcctcttccggagaaagcacaatttccctgcgggcagccagaagcgtcatggccttgatctgggaaatctccgccagaaccttgtccttcagccgctcttccagtcctgccccctcagactttgtctcccatatttccctgccgtataccgactcataggtattctgctcagtggtcagatataccataagctcaggaagggtacaggaggtgtcctccagacggaatatttcatttttattaaaaccggtggtaagtacgatttttaccggttccgcgctgctgcaggcattcagcggcagcagcaggcaggatgccagaaggcagcccgccagcctcattgctgtttttttcattctcactttcccatgcttttaataatgcttcttgccacactcaggccgttggcggaagcctgctgaagccctctggtcaccccggcgccgtctccgatggcgcgaagccccttgatgctcgtttcaaaatccttattcaccaccaccttgttggagtagaatttcacctctacgccgtaaagcagggtttcgtcactggcgatacccggagtcaccttatccagcgcctcaatcatctccgcgatatccaccatgatcctgtgagggaataccagagacagatcgccaggcaccgcatcctttaacgtggggatcaggttgttccggcacagtctctcctccgtcgtccttctgccccttttaaaatcaccgaaggtctgcacaagaatcttaccgccgcagagcatgttggaaagttctgcaattttacgtccatactcaatcggtgtgctgaacggtttggtgaaatttttggacacaagcaatgcaaaattcgtattactcgttttataatcctgggatttataggcatggccattcaccacggcaagcccgccctcataatattccgtcgccacctctcccgaaggattcgtacagaaggtacgcaccttatcatcaaaggtaggcgtatagaaaatcagcttcgcttcatacagattctcattcaggaactgcatgacctcgtcacgcacctccacacgtacgccgatatccaccgtacccggcgttgtctctattccgatctgcgcgcatttatccttgaaccagtcggcaccctcacgccctaccgcagatactacctcatctgccaggaaggtatctcctttgtccgtgaccacgccccttacatggccgttttccacaagaatctcagaaaccatggtattaaaaagcatttccacgcccttttcagccagcgcctcctgcagacgtgaataaatcttatacccctcttccgtccccagatgacggatagggcactccaccagcttcaggtttgcattgatagcctccctgcggatttcccggatctccttttccttatctataccatacacacgcgtatccgcgccaaacttcagataaatatcatccgactcatgaatcagagcctttgtttcctcatatcccagaatctccggcaggttcccgccaacatcaggcgacagggaaagctttccgtccgaaaaagcccctgctcctgcaaagcccgtagtgatggaacagggcttacagcccacgcagaccttggtcttcctcttaggacacgtccttttttcaatcggccgtcccttctccaccatcaggaccttcaaatccttattcttctccagcagctcataagcgcagaaaatacctcccggcccggctccgataataatcacatcataattcttctccatataaacccctgttctgcccggtcataaactttattttcagcatttcaaacacctacgaacctgtcgtaaatgccgcacagtacccctctttgacatttcctgcgcctcttacggccggacaccgtaaacctccccgcagccatgctgtttgccggctttattatacctattttacgggataaagtcaatgaaacctgcttttccatccaggggtgtctttcatgtattttaactgttcattatcttcacagttcctgcagtcctgttatatccagggaaacgaaatggcaaaaagaaatagcatccctccccgcaaatcatgcagcgtccggatgctactctttatagttttttcaagcgaggattatcagctctctgtttctgtctgcactcttttgagtttaatactatacagtactacagcggaaaacatcagcttccaccacacactgcggcggcttattttacgggttcagaaccgacttttctttccagttcttctatccgcttcatggctttatcaagcgcggcagtctgggcagcaatcagctcctgcatttcttcctcgtgcctcttcttctcttcctcgtgcctcttcttctcttcttccaacgcagcagcctgcgcatctatcgttgcctgcatctcgtctatcatatactgcactgtgttccgatccatctctcttaattcttctgaaaacattcccatcaccttctccatattccggcagacttcatatacgtccccatacatctgtctgaacatcggatatttatttatcagctcgattatccgctccggatcctgcgtgctgtaaaacatcagccacgcctccagttcgttttctatgcttttattttccatgtttttttggaatatgtcaagcgtaataaagataaaattctgtaataaatccagctccagccctgtatcaaagctccagtcagatttatgcagatattccttttccatagaatgaaattccacagggcttttctcaaaaagcactatgacatatacgtttttgatgtccttataactgaacttacccttttcccggtttctcttatcccgtgcccttttatactgcctcaacagcagatccgcagcataacaggcgctgcgttctccaggaaaggcgtagcccagcttctgaatctccacatccgccaggcttccgtcctcgaattccaccaggatatccgtgactaataaggtattttcgtccgcaatccttccgccctcattgggcagcacctgacggattaccacctttttccccagcagcagcgacagaaaacaattcagtctaccgggtgtatattccggactcatgatttccttaaaaaaagaatcataaaggatctttacgcccttcatacctgtacaaaaatccaggaactcttcctgccgttcaggcgtccagctccggaacagcgcctgcagcccgctgctttcaccgatttctttcaacacctcctttctttccctgataagcggaaaataattcctgagcctgttttccataaatattcctcctgtattaagttttttgccatttacggattattgcttcgaaaaggaagcgccgaaatgaaagaacggccggacggccgaatactacagcagcatagatactgccgtatgacggaataataataacatactaattcaataatatcaacatcaaactcagtcggatacagaactttttcacgaagaaatatagtttcaggccaattcaaacataacgaatccttacttttcaccagcttttttcctgtcatacccgtaaggcatttccaccttctgcctgccaaaggtgatgtccggagccaatggactgtgcggcggggctgtctgttaccggcggtgtggggggcctgtcctggtgtatgggaccttggggcagagggcggcggggagggggaattcaccgatacttacgaagttttggagctgtttcttaaagtaaccgaaggaagctttacccgcaatacggcagctgtctgaggagcctgcgacgagttcctgccgtatcagggttgtaaaagcttccttcggttacttttagaaacagcccaaaactgaatagtatcgatgaatccccctccccgccgccctctgccccaaggtcccatacgcaaggacaggccccccacaccgtcggtaacagacagccccgccgcacagtccattggctccggacatcaccaccctccccccctcaggaatgaatccggctgccggtgtttttcttttctatgaaaatctggctgcttattctttcctgcagttcaggcacatgggaaataatccctatcatcctgtcgctctccaccagtcccatcagcgcgctgcaggcctgatccagggactcggagtccagcgcgccgaagccctcgtcgatgaacagggcttccacccggattcccccgctctccgcctggatgacatcgctcatgcccagcgccagggaaagggaggccttgaagctttccccgccggaaagggttttcacggaacggtatttgccggtgtaataatccataacccggatttccaggctgtccttgcttcgtccgtcgcccgcctcctccactctggacagctcgtacctgcctcccgtcatccggcgcagccgcaggttggcggcttccaggatatcctcaaaatagccggaaagcacatactgctcaaataccagcttgcgggcattgttccctgaagccatattgtccagatcgcggatgatgccataggccttttcccgcttctccatatcgtcctttttcgccttcaggagccgcagggtacgggcggcgtctgaggcggcaatactgcagtccgtgcgcagacgctctccttttcttttttcttccctgagttcgtcccgttttagggctaaaggcgcggtatccgtctcttcctttcccttcagctcctcttccatatgggcgcaaagctccgtcagagaagcggcttccatccggtaacgggagatgctctcagacagacgccttcttgcttcttcctcaagaactgcttccagataggcctcttccccggaaaatccgccgttttccaaagccgcctgccatttgccgcgggcttcccggcattccttttccagagccgccttatccgcggccagccgttccagattctgcctgcgcactgtctgcgcggttaccaggcctgcatagcgctccgcctgctcctgcacctgcgcccggctgtgctgtccggcaaaatccgccaatgtttcaggaaatgcttctatctcactgtgcagacgtttttcctcctccgcaagctgccggttctgctcctcctgggcttccagctccgcccgggccgccgccgccaggccatgtagcagggtcagcctggcgctgctttcctcataagcctcctgcagccggttcagctgctcctcgtcaggcacgtcctcctcagcgcgcgctaccttcggatgttccagggaaccgcagacgggacagggctttcccgcctccaccaaccgggccgcaagcccgattacagccctgcggtaccggttctgcgcctcggtcagagcctgctgtttctccccagcctccttttcctgggcaaggtaatccgcctgctgcctaagaagcttttctcccagctgtttcttacgcttctctcctgcttcctgccgggccttctgctccgcctgcgcctgcatgatatcgtaaaacacaagcagccgttccctgttttcataaaattccctgcaggacgcaagcccggcctcatccctgacgatagcctcctgctccgcctgctgctgccgggaaagcgccgcaacctgcttttccagggagtttaccagctggtattccgcgcggatttccgccgcatgctccgcacgcttcagccgctcctcctcctgcttcatttcctcagccttttccttcagcctcttcagcttttcccgcgtctcctgcagcctggcaaaggattttcggacgctctccgcctgttccatctgcttttccagctccacaagctccccatccaccttctctgcctgcttcccggccgccttctccgcctcccggtactgtttttccagctgtccgagcctttccatcagcaactcataagaataaccgccgccttcagtgagttccttccagatctcatcctccgtggaaaactggcgcacatcctcatccatccggtgacggtactccatcacttccttatatagattattggcgtcctcccgcagtcttgcagcaaaacgatcatagagcgccgtatcaaaaatctcccggaaaatccgcgttttttcattgggagaggccgtgagcagccgggcgaattcgccctgggcgatcatggaaatctgcttgaactgtctgtaatccagccgcagtatttcctggattttcctggtcacctcgctgctgccctccacagcggtcccgtccggcagtgtgagcacagctttttcccgctccttcgtcatggcggctttgccatttttccgcttcttcggccgcatgtactccgggttccggtaaatccggtaaacctctccgttatgctgcatcacaagctccgcgaaggtgggcgtgtcatcctccgcaaagtcactgcgcacactgtttttttcccggatttccccactcatgtttccgtaaagcgcataggttatgccgtcaaaaaccgttgtttttcccgctccggtctgtccggtaatgagaaaaatgccgttttccgacagctttgtaaagtccacggtctggctgtcccgaaaaggaccccagccgcacagcgtcagcgtaattggtttcattcctatccctcctgcatatcacaggcccgcctgcaatactgcatcatccagcagcttaaaaattcctttcaaacctgctccaccctcttcaccgtttcttccgtcacctgtttcctcgcttcatccatctcactgccgcgcaccaggctgtaaaaatcagcaaaaagctccgccgtactcttcctgcggatggcatgccgctgcatcgccgacagccggatttcctgctcccttttggaaagtacgatctgacagatattggggtatacgctgcgcagcgtcccgatgggatcaatcagctcctcctcgttggtaagcacggcctgaatataatcctccgcctgcgccccctccgcgcccccctgctccatcagctcctccaggcttcccctgattttacggagcctgtgaaggggaacaaggggtctttttttcaccgaaacctgtcccttttccagaagctccaccacattgatgctcttttcatgcccgcattccgaaaagctgtaggccagcggcgctcccgcataccacacatttcccggccccatctgctgcggcttgtgaatatgccccagggccacataatcaaagggggcaaagcagcgtccgtccacgttgtcaatgcctcccacatgaatggttgtttccgcgtcggaaagctccggctcccgctcctgccaggttacaaaaaaatgggtgatcagcacatttctttcctgttcatccagctcttttggcaaaagagaggccaccgcctcttccgtcgtcctgcagccggccgctgccgggcgcacaaagggcatcaggtaaaaattcactgggccgtattcatccgtaagcgtcacctgcttcaatggagaacggctggcccctgcaatataaagcccctgcttttccagaattgcctcgccgaagccaagacgctccggcgaatcatggtttcccgcaattaccagcaccggaatgccctctgcaagcagctgcgtcagaaattcatccagcagcttcaccgcctccgccggaggaaccgccctgtcgtaaacatccccggcaatcagaaaggcatccgccttttcctctctggccgcttccagcagctggtccaggatataacgctgatccggaagctgtgaaaagtcattcatgcttttcccgatatgaagatcccctgtatgaattattttcatccgatttctccttcctctgccagcagggcagagaagcacaaaggcataagcccgcctccgctgcctgtgcagcgcgtatcgtaaccacgcatcaggctccggcctgcaccagcagccggccatccttcgcataccagcggacgccgtccgtaatcacgtaatcctcgccgccgcgcagtgcttttatgaaatcctgtccatcagccagcttcctcggaaacgctgtccctcctccgaaaatcgtagtggaatggacatccgatccgcccgtcacaggaagcccgtgttcctttgcataagccctggcctgtccgtcccaaaccgtgcttttatgggataggctcagcggattggtatgggttgcgttcaggccctccacaccgtccacaaactcagggaacagccgtacctccgggatataagcctcctcccggaacggatgtgcatgaaccaccatgccgcccccttcctttaccaggcggtactgctcctttacatctgcttcctttatttcaggatgcgccgccagccattccggcgtcagcccgtaaatcaggaattccgtcccgcaaaagccggcctcccagccgaagaaaacatcaaggccaagcctttccccttctgcccttgcctcccggtagcccttcgcgaattccgccgtccactcctcccagggaagcgacctgtccaccgccgtattgcctccccaattgtgatccgtcacaaaaatcccggtatagcccgccgccttacaggcccgcgccatctgtgccccttctgctttcccgcaggcgctcccctgcgaggtgtgaaggtgtgtctcatataaataaggatatgcttccttaatcgtttccgctgtccattctgtcatgaccattcctcctgtaaaacctgatgtcaatttatccaatcatttttctggtttgtctgcactatcgttccacaacactccaatcacacagcgcctcgtactgtgtaaccctccgcaactcatcccgcacctccatcagtgcaaagcccagaaggttttctccccgccattttaacggatccctggcctccggggaagctgccgaaagatgaatcccccaaacgccgtcaaaaggactggcctccgccagcacgctgtcccctgttgaaagcaggaaatcgcgcagcgcccggttttggctgaatttgcaccagctgccgttcaaaacaatggaatattttgccctgtcccacagggtctggtcgaaattccggaccttcctccccagcgccttaatctgcttgggatcccggctgtccaaaatctgcgcgcgaatctcctcatctccaaacagctccgctttcgcggccatcatgaattgctccatgcagcagtaagtatgcgcaatggaccaaaattctgcaggccaccactgactgaagcagctttgggtaagctctccattttctgcaggctgatgtccccaaaacagacagaaatcatgctttatccctccactgctctccttctgaagccagggcagtgtatatttgggtgtcccattggctctccacaggggtatccaaaacccgccatgcttcaatacttcaccggtatcctcatcctgccaccagcccttccaggcggccggttccgggaacagagcctgatactccatccgctcctctgaagaaagctcttccagccaggagaaaaaacggtatatatactcttccccatagcccatccgccagccaatagagtaccgttcaatttccgggcaggccagccaggggggaggcatcagttttttatcttttaagtacatgtacatcctcctttcatgtgcctgagcactttctatttcttttcttctttattcagatacaaaacagcaaacaaaaacatcaaaccaaggaaaacccagggcagcgctccgtttaaaaaatcaagcaatggattccccttaaatacttttccaaggataaacatggcagtaccggctgcaatagctacccaggcaaacataataatttttttctctgccttagcatcccttgcatctttttctattttttccatcaatactttatctcccttcagcaattcatcaagacttacttcatacaactcactcattcgaataatactgataacatcaggcagcgatttcccattctcccagttagagatggtctgtctggagaccagaagtttctctgctgcctgctcctgtgtatattcctttttaatgcgggcgcttctgattttatccgctatattcatatgtccctcctttgcttataagattaccaaattgccatatctctttccgtcaaatgtcttttacaaaagaagaaactcatgtaaaaaagcttttacatgccccaataatctacccgtacactcctttattctatttcattttcacctgacaagcactgcattccctgtcatggcttcaaataattcccctgcattttttgcaatcccctatgcaaagaatggggtcattttcgataaatcccaggaattatcaccatccattttaacaaaaagaaagcaatataaatccgatttattcttttaaactccatcggacataggcccattgccttttcgtattatccacattttcatcatctacaggagtcccgcattcctgataaacataaaaatcataaagattttctttatgcttatccaaataatactccgttccgttaatgtaagcatattttatttgttcctctgtaagtttaccgccgtactcataaccatctggcagttcattaacgattgagacaatatctgcaaaatactcattgccatttattacaataacaggggcgctgtcataagttttttcatcttcgtctggttggcttgtactacaggctgctgctgagaatatcaggcataaaatcatcagtgtactaatgattcttttcatagttaacctccgtgtattccaattttttgttctcctgacgttcgaatatcaatatattacctcccggcaattcaattttttctccccaataagctgcaagttatcactctgtaaactttctctctatttctgcatctgttttataaaatccaaaaagcaaaaatcccactcccacacaaataccaacaatcagggcaacaccagctgagatgtgcagccccaaaaacactacacttaaaattatctcgattactcccaatatcttcccgagagagatgtagttatatggtgctatattctgtgcatagtcccagtgctcctgggattttcatgaagctggtgtgttatacccattatgcgacttcatatccattacaggatgttttttcaatatccatccaaccaaaatcattacaaatggtattattaaatttaataacaataaggaatacatcgttttctccacaaatgctggtttgtcccgtttttgccgtccagtcttccataccggtctgattaaattctgagccagcagcgtttggcaatgctgcaaactcaactatcactatctcgtttccgtcaatatcttttaatcgaacctcatataatttcctgttttgaacattgtttctttccttcaaattagaagttattggtagaataccatttcgacttcctcctcgtcctgcccacctgtaaaggagaatcctgcacatagccaaagccttgataagccttgtcagtcatcatgtgccaaacttctgattggatacttcaacaaaccgcttgattaattccaatctatgtattcttataacaagaaaaaccgaatactccacaaaaccaataaatgtaccggataataaaaataaaacaaccatttgttgaagaatacatatttttcagacttttttccattatagaatacctggattacaattcccgccaaaatccaggaaattatcgcataaaaaccatgtaataaggcatatcctgacaaaaatggataaggtgcgtcaacaggcgcatatcctggcacgttcaatacaaagaaaacagcacacattattatccacgcctgtatttgtttttttctattccccctgctgaatttgaataagattgtggctatgggaagaatcagggcacaatcgcagagtgttgataataaaatcaaccctaaaacagatagtatcttctgaattttatttagtctgctgtctaatagtaataaaatacaaaaacaaatcaggaaagtaaaaataacattcaactgaaagtaacccatggctaacaaataaggtatctctgaaattaaagcgaaaaggaacaaacgcttagcataatctctttttgaatgtgtatagaaatagccttccaccagaaaatagcacatgataattgaagtaaaataccccatatcttcaaacacttcatatactactgtcccaggtgtcataaggatatgtgcaatgtggttgaacgtcatcaaaacgattgccagatattttatttggtctctatttaagattttataattcttttccatgatagcttacctgcctttatatgaaaaatcattaggctgcctgcggacagaatacagaaaatgaagcatatcaccattataataccgggtgatgaattcatcttccctgctcataccaatgctttcagctactttaatcgatgcaaaattatctgctttaattattgaatacaccttatccctgttcaattgttgaaaagcgtattccttacaaccgcaggcagcttcttttgcatatccatagtgccaaaatctttctttcaataaatagccgatttcaagtacttctgtattcttatatggctgtaccgtaagtcctgcctgccctattatttcattggtatcttttaatacggctgcccacaaaccaaatccgtatttcctatacctgtctgcttgcctgtcaagccattcctgaacatcactttcagaaaaatcatgttcataggcatacataacttttggatcctgcaaaatctcggctaaatcatgaaaatcagcctgccccatttctctcaaaatcaggcgttctgtttctaatatcattagattcctcacttaaaattctaaactatgcccgcagctgctatcaagtttcagccggctcctggtttataatcccgtaaaccgggaaaagcggctgttcattcgactttgatatcatactccggcggagattttatatcaatcgtacaaaatctgtatttttccttatgcccgtatgctccgggacatatgtagcaaccgcctgcaattttaacggcctgctttctgaagattcttttcagttcatcatacagctgtttaaccgtattattatcataatacatcgtcgaaatttctgtcgggaaaatagcgcagtctttgtatatcccattaaaatcaatacaaataaaggctgaatttcctgcatctaaagcgctgtatctttttatctcctgtccatcagcgtccttgtatcggtacgtccgccacaggcattccgcggacttgaaaaaaacaagtatctgcctgtttccatggtgggaaccatgaaaattaatacccagattttcaatatccatgatgttatcataagaaatttcccccgcatcagagtaggccggtacgtaatatatttcccatttgccttgaagctcctcaaatacgttctgtaaatcttttttttctgcaaaagcccgaaaacgtcttattttcatattgatttttccagcccccatagcccggtactccttacagcaaattatgaaccttttagccaattttcactatccggaaaaataacgactccacactggtccaaaaaacaagctctcaagtacacctctcccacagaggtaaacaaactctaatcagcccgactcaccgggatttgtaccaatctatttatttcctaacatttccaaagcgtctttcatagagatacatctggcatatctatcaggccacataaaattgttataatatttataagccgcctcttttgagaaatacttattatcaaatgttgaatttgtgtactccggaacaatcatatcaaagccatgctcaaaaccacttttaattgtcgcatcaatacaaaaatcagtttgcaatccgactatcagaatttgcttttcttctctttcctgtaaatatgcaagaagccccgttgatatatgaaatgaactgttcacagtcttacaaaaaattttctcatttacttttggcttgaattccccatatatttcatatgcttcatcaccttttgtaaatccggttcccggaccatcatcatgctggacatatatgatttcaactccattttgtcttgctgtttcaatcaatagcttaatattacgttttaccttttcaaattcatatagtctattatcagtaattccattttgcgtatccacaactaataaaaccatttattttctccatcaaactcaaatttttgcattacattccggaattaagtttttttttgcaaatctaccaacgatttccgtaacatgacggtctggggctgcaaacccgataatctctttcatagcttctgttgtatatccttttgcccaatatcaacatgtttcaatatcatatttttcatagcagtttagcaacacttcacaatcacaatatccacccatttcacggatttctgctattacactttctattttttctggcggtaaattattttcaagccactgttcagtaaaatgtaaggtattatcacaggcagttttcaatagttgtgcttccaaataacgaaaaaggctccgtacctttgttttactgagaatatattttttattttgagcagctttccattttttcagtaatgcttttttctcttcttttgacagttctgacatggtatagtactcctttgcaccaaaatcaatcagacggatttaatctgtctattaaactggaactgttatttccagaaattatttattttatctggaagcaaatttatatcgtctcccaaaacagttacatcatcttcatccattaaagccggaacattaaaataaactccatcgctgtcaattccataaagttctccattaccgtttgaacctattataatatgatcaggcaaaaaatcctcaatacaataatcatcattaatttcctgcaaatcttccaaggtgaaaagttcaagccatgtttcaccaatatcaccttgaccaccattatgctttttcataaattccaaatattgctttggcaaaacaacattgtttatttgcttaatctcattcccaatataaggttcattaaaaacaaagtttccccatttatccatatttaggttctccgctataatatcaaatatctctcttgcgtctcatctgccagaagacaacttctattgtttaatcaggaaatgctatatatgaattcatcctatggtgcatctttgtgtaaaatctcatatatttctgtacacaaactgccataataatttttcatcatttcttccatatcaagcttcgctcacttaatatacgctgtaatttgaatcgttccattatcggaagtcatttggagatatccccagtcaaacaaaagtgagccgttgtcatccgtacctgtggaagtcgtttgataatgctccaacagtgcggtatagtccgcgtccgttgtgtcctcaaaggtcacagttaaaatagaatcgtaatctttattatcctttatcccggaagaataataggtgttacccaatgtgccaaccgtcatttccaaaacatccggaatatctgcatcatccacccccggaaaaatgccgtccgttttttcatttccggcattgcaggcggtaaaactaagtattgcacaaaataaaagcagagtggccatgaccttttttccaacagacttcataaaaattctcctgttcccatattatattttgtcgtccggcattcggacatttcgctgtttttccagttcaaaaaatatgcctgtccgcttattcttcaaaccctggggaatatttcacaccagataaaaatatctgctgaaaaattcattcaaccttattaaaaataactgtcttctctttcatggatattttccctacctgataaccatattccgtaagttcttttttataattcaggaaagagtgatcaagtggtattcccacaatatcctgtatttcttcaaaagtcagcttaaatgactgactgccttttttctgtacatactcccataaagaatcgtatttactcatgattcatattcctttcttctaccaacaatttttacataaaatatcaaagggtgtgtagatcttcaagtataactctatatccgtccccctctttcaaaaattctacttgaattgttaaatcattccctacaccgtttgttgtcaggtcataatccagataaaaacctccgccatcgctaaaaggcgccaaacactcctcctgatacctgtttgttaccagaaccggattgtccactttcagtacagggcgggtttcatctaagtatctgagcgctaagatcaggtcctgctctgataagcggctgctatcaaactgcgctaaaaaagaagaataattttccgcagataatattcccaatgcgtgttctataaaagcaataaaactttcctgttcctttcctttctcagcgtataccatcgcctatccctccttatcacattttatatagtaattcttccacttacaggcacaccttcagcccatttcccacaaaggaaaccatatcttcatggcattccgtaataagccattcatattttacacaaacatcatagcacaaaaagtcattatgttttgccggaatgagcttaaattcagtatccctgtatccgcgtttataatgtatttttttcgcaggcagcgaagcctccagtacaatctctgatttgtcgaatacactccatcccccacagataaaaaagcagggtcaggattattccattttctccgaaatcatctcagttctacaatgacagaccccttcattgcatccacatccttcagtaaactgctgtaaaggcttttcgatacagtttcaaagctcaggctattatcatctgtcaacacgacaaagcagctgtctttctcagcattaggcattctcccgtttaactccagcctgtacttgtatatggtatcatcacatttccatgtgccatccttcatttcataatatgtcttcattactccgctgtcttcggattgttcataggtattaacaatctcattttctccgcagccgacaaacaacatcaggcaagcagccaatattgcaaataattttttattcatttcatcctctcttacctgcgcttaatgcctaaataccaaacaatccattagattcactgccgcccggacattacaatttacatatcattatatattcttcttcattttcagcaaccgtttgaaatccgacatttttatacatattcacggcataattggctttttggactgctaaagaagcctgtttataaccattttcccttagcagggcaagcatccttttcattaaagccgtaccgattccatagcctctgtactctttatataaggaaatcgcaaatgacggggtttcgttatctatatggccgtaatcatccataatacggacccaggcggcgccgatgatctgagcattcgcctctgcaaccaggccaaaatctccggccctttttccaaattcggctacatacacctgtaattccggcttctttattatatttttttccggcggctgtactccctccggaacaaatattgcctcatataagaaatcctctaaaacagctgtctcattttcatttatttccctgattatataattcattccatacctccgattatctgcaatttagtaatccatgcctgttttatccccagatatccggaatatcagagactttcaaagctttcatttctttttcccttcagcagatattcaatatcatcaagccttttataatatgactgtcttgtcctctctaattcctttagaacgcagcttcacgttcttttgccatttcagataataaagttggcaggtcgggaaaggttaaatcttctgcgtattctgcccgttctataagtacttcaaaatccatgctgtcaatcattttcctgctccattcccggttttcttcctgttgcgaaagcgcaggcacactttcctccgtgagtcccaaatcgtggccgaaagaccacaatttccgctccgcctgtaagtcagtagaaccttcatagggaaagaaagaaatagacatataattttctccctcttttgtacagtgcattgtcactttgttaaattctccgttttcatccagataaaacagtaactccgcaaaagttatttgctgcccgtctatctgtgctgcggggtactccgctttcagcaaattcttatggtcagtagccatagggatatatttacaggtaagttttacatcctccagttctaaaagttgacgggcaaggtcccatttttccttagcaaaattctctgtttcaagtttttcccactccatatcacgataaaacagcttgtcatcggtatagtaatacaaacgcccgtcataccagacagaataatctttcccgcttatttcataataggccaacgtatattcttctgttttataaacatcaactatagaattaaaatcactggaaacagaatagcctttccagtccccaaaatcaatttgatacatgcttgaagaaatatcctcataaattgcctgcgccttttctccggaatatgtcttttctccaaaaggctcctgtcccggcagcgcaatacagccggaaaggaagcaaaacagaccgcagataatacagattgcttttattcgcatttgattgaatcctccaaagtttttgcttttttccaccgaaaacggaagttaactgcaaattgctctcagccgcagaagagatatcccccgatattttctgattcttttggggcatacattttgcgtctataccaatggaaaaaatcagctttctccgttcatcaaacattcaatatcaaaaatatgacaacacaatattcattatacaacactccccccgccatacacaaacttttcctgtaaactgttggaaccatagaatttccatataattttattatggatttcttttccaatcagttcttcctgtattcattatttcgtgctatactaaggatttgagtgaaatgctaatcagagtttggagggaaagaaatgtactcacttttacttgcgcttatttatgtggcttttatcagtctcggacttcccgattcgcttcttggttcgggctggcctgttatgcacagtgacctgaatgtgccgatttcctttatgggaatcgtttccatggtcatttcaggaggaacgattatctcaagtatcctgtccgacaggctgacaagaaaattcggcacccggattgtaactgttgtcagcgtatttctgacagcgattgctttatttggtttttccatttcaagccagttctggatgctgattattttcgcaattccttacggtttcggcgccggggcaattgatgccgccctgaataactatgtagctattcattatacgtcaagacatatgagctggctgcattgcttctggggcgtgggaacgattgtcagcccgttcgtcatgagctatgctttaacaaattccacctggaacaacggctaccgtattgtctcattcctgcagctgggcataggggtgcttttgcttgtaaccctccctgtctggaaaactaacgggcagaatgcagatgcgaatggagaaagcatcggaataatcggtgcgctgaaaatcaaaggcgttccgtttcttttaaccggcttttttgcctattgcgctgtggaagcaactgcgatgtactgggccagcacttacctggttgaagtaaagggcataacagtagaccgggcagcccaatttgcctcgctgttttacatagggctgaccatcggccggtttctcggcggttttattatgaataagcttggtgacagaaggatgattcttctcggcacctgcattttatcctgcggggttatttctttgatgctacccacagggaatcagctcgtctcacttattggctttatcattatcggcttcggctgtgcgccggtctatccctgtattattcattccacaccggataatttcggcgcggaatattccggggcgattatcgggatccaaatggcaagcgcctatgtgggctccacctttatgccgccgctgtttgggcttctgggcagcttaatcagcttcagaatacttcccgtgtatctcgctgtttttattatattaatgataaccatgacagaactgaccttcaaaatcacagccaaaaaagacggtgggaaccgttcataggggctgctgcataagcctcctcggtgaaggctggtattgcactgaaacctttctacagtaatgctgaaattcccgtttacaatgcattccagataaaacaaaaagcaaggacacagccccatgcgttccctgttttcttcttcactatcaacattccgtagattgcaataaaagtagtaattaattcaatgattccccagaaagaaaaactgagcggatgaaacagcagacagattattccacaagtgatggcgccatagtctaaccattgattttctgaaggatatcttctgtcaattatctcacagataacagcatagttaaagccttcaaaaaacccccagacaattacaatgagcgccatccccaggaccgaaaccggaaaaccggccgccagcacatcattggttaccaaaatgctgaaaggccgataaccgtcgaactgtccgctggcaaaaatataacagatcgaggggataaaacataaaaacgttcccactgctgccttgccagcattctttctggttaatccaaatgctgtaaatttttccttccgcagaatacagacaatggtaattcccagtcctgcaattccaaactggacacctgcattcagcagcagacgtggaataattgaaatatcactgtctttaacaaaacccatcagctgctctctcattaccgcaaacaaaaggaaaactcctaatgtaacaattgttacaatccacaaatccacatccagttttttctgttctgcacttaactgctttttggccatactgcctcctcccaaatatcatggttatacatcttcgcaataattccacgccgcttccaacccgccacagcttaaaaccatttgctgggaattgtaagaaaatagtcatttttctgcctgaaaccaagcttctcataaaatcccctggccatatccgtctgcaccagccactcagagccttcacaggcctgcctgcatcttcgcaccagttcactgccgatgcctttgtgttgaaaagcaggcagcacggccaaatcgtaaatgacagacctaaaatgcagatcacttaaaacccttacacatccaaccaattttccatccgcccacgcagaaaacacaaatgtggaatgaaggaagccgatattaaaattatcaatcatctcctgcgtcgtctcttcctcttttgcccagccaaccgcaagaaataattgatataactcatcacaaggcaaattcttatgctgtttatattctatgttcatttttatccccctgaccgcaggccgccctgcgatactgcattaacttatcctccaaatatcactcaaataccgctctgcaggcaacggggcataaagccccccttataatggaatctaaatccatacttactgccatgccggcctccttattttaaaatacactttccgttttttgttgcccccagatattcaatgattcccatatcttcaagttcagctaaatatctttctactctattttagccaaaacatcgctgaatatctggtagttccttattacatcatcatcaagattatcgtcttataaaagaaaatttagtttttgtcaggatcattaagtactttttgaatttttcaattgttccaataacagcattatatgttgattgataacctaattactcctcccttatttttcaattattcaattacattgtaatgtaaataaaaatctcagtaaagaattttttatatagcattgtatttttccaacattaaaatgcaaatttaattttctatataataaaatgccggaattatcaaaaaaagaacgatgtccgtccattcgcacctgctctttctaaaaaaacgtgacaaaatatttattacggggcgacatgctattttgcccttacatgatatgttccatagaaggtggtatctcagaagtctgttacataatggctcgctgaaataaatcaccttctgctaaaaaggactgacacaccaccttacgtgcgtcagtcccaagaaaatctttttattcataaatagaacaaataaatatcagaatatccataaccattccacaacacatgttacagaatagtccttacccatccttccggtccttcaattcttcccatctggattccggtcagcgtatcatacagcttctggataaccggccccatctcgtccatgccgctggcaaagcagatatccctgccatgatccactacctttcccacggggctgatgactgctgccgtaccgcaaagtccgcattctgcaaaatccttcagttcctccagctttacaggacgttcctccacttccattcccagcatatcctttgccacgactaccagggaacgtcttgtgatggaaggcaggatgctgtctgatttggggataatgattttgccgtctttatctacaaacaggaaattcgcgcctcctgtttcttccacataagtcctggtggcaggatccagatagaggttttcgtcaaaaccattagcatgtgcggtcacacatgcatgaaggctcatggcatagttaaggccggccttgatatgtccggttccatgaggagccgcgcggtcaaaatcgcttacgcacagggtcagaggctttgcgccgcccttaaagtaaggccctaccggcgttacaaaagcacggaactgatattcctccgcaggcttaacgccgattaccggagagcttgcaaacatatagggacggatataaagagtggctccgcttccataagggggaacccatgctgcgttggccgtcacaaccttatcgatggcgtccaggaatctttccttgggaaatgcaggcatctccagacgtttcgcactgtcaatcatacgttccgcattcagatcaggacggaaggttacaacacgtccgtcttcggtcgtataagctttcagcccctcaaatatttcctggcagtactgcaggattcctgcgcattcattcagctgaatggtaggatcctctgtcagagttccttcatcccaggccccgttcttatagttggatacatagcgcttatccgttatgtgataaccaaatcccagattggcccaatcaatatttttcttttccatcgcagctcactcctttgttataaactttactgatttaattcattgaatcctattatagcactatttttttatcagtcaaagatttttttcatcacataattcgtgagcttaactccctttcgcaccacctgctgttccttcatcacccgataccctcttttttcaaaaaagggcctggcggtaatggatgcatgtgtggtgaaatacgctgcggcgcatttttcttccagccggtcacagagggcgctggcaatcccctttttctgataatccttatgtacatagagccggtccagatatccggccgcatccatatccgcaaatccgacgattacgcctttttcctccgcgacaaaagtatcatgctccagaaaggagcggttccaggccgcggtatccaccttgccatcggcccaggcatccagctgttcttttgtataatccgcagcgtttaccccgtgcaccgtatcgtaaaaaagcgccgccatttcccggcagtcctccggccggtattccctgatctccattccatcctcctgtatacactgctgctacagcatcttccttttccgcaggatccgtatcacaatcaggcacagccccagcgtaatcaggcagatgatcccgaagccaaagggcgtattcgccagcggcatccatttttcatccacgttcattccgtaaatcccggaaataatcgtggggatcgccataacgattgtgatggacgccagatatttcatcgcggtattcagccggttgtcaatcaccgccgaaagcagctccctggtgcccttgatgatatcccggtaaatctgggtcatctcgatggcctgctggttctccaccaccacgtcctccagaagctcctgatcctccgggtacttttttatcttactgtagcgcaccaggcgctccaggaccattttgttggcgcgcagggaggtgtcaaaatataccaggttggattccagttcatgcagatcgataagatccacatcctccgtatccccgccgatatgctcctcaatctccttccgcctgcgatccacaatccgcagataggactggtacagcacacaggtccgcagaaaaatctggtaaataaaacggatctgctttttcgtgctgaattcctttaccatgttatccgcaaaggattttaacacaggcgtatcctccgcacagaccgaaatcaaagtatcccccgcaaaaatcaaaccaagagggatggtggtatacgcctccctcttgtgtctgtattctatggacggtatgtcaaacagtatcagtgtataatcattgctcacatccacacgggagctttcctcatcatccagcgccgcccggatatccgcgatatccacctgaaattcccgcgccaccagaaggcattcctccagagagggattcacaagattcacccatgcgccgggtctgaaatccgttacttcgcgaagcagatttttttccgttacatatcttctcatcatagccaggttccccgctttataactttagtaactgttcagtccccctcacagttaccatttttctataatttcagaaccatcataacacaattatatgtttttttccaaccggattttacgggacacgggcgcctgacggcagaacggaaaggaaccataacagttctcaatgcacctgcttatccctccgtcccctgctccatctgcgccaaatccaccatataaatacaaggcttcccctctctgtccgatacaaatatcacatgcctgttatcctccgtaaagcagggatgggggtgggaatcctggggattgccgtgcaccgccctccaggacgtcccatggtagcacagcttcctttcctccctcttttccacatccacgaggtaaatgaaatcattcttgatttcaccgccttcctccggctggtccttcagcagatgaatcggcacatcgctgccctgggcatctcccaccatgtaccggtttttccggtcacagataaaatgggcgtaaggagaacaaggcataaaaatctcctcctccatggtatccgggtcgatcatacggatattctccaccttttctccggtggtttcccgatagacaaaggccagctttgacccgtccggaagccagaattcatgagtcagaatcaaatccgaaggctgctgcctgcagcagcggtaattgctcccgtcgctctggaccagccacaatctggcgtcaatgagatcgtaaggcccctcatggcagaacatgatggtgtccggatccccgggacggatctgcgcatgcccgaaccagcagtcatcctccagcaccgtatggaagctgcctgtctgcagatcgcagtaaacgatgcggcagtgaggcttcgccttgcaggtaatcgcaaaaaagtcccagtttgcccccttcttcttctccggcagggaatccctgcgtgtctccacaatggcaaggaaacgattgtcctcgctcattccccagtttccgccgttccagccctccggaatgcggtatacacactctctttccagcgtttccagggaaagcttccagatcgcctgctcctgctggtaaaaaatatgcttatcatccgccgcaatcaatccgccgtaatcgtccagcccttccccttccgtcagctgcacggcatcacccgatgccaaatccataagataaagctgacgctcgccgccaatttccgcacaatacagcaaatgagagccatccgcagtcgtcatacggttataaaaatacatatggtgactcacatgatccggctccgtgagcctcaccaccctcgttcccgtctgttcatccgtaaactcctgaaaccgattcttaatcatatctcctgccgccatcttttcctctccttattctcccacccaccgttttttctatactccgaaggatgtattaaatgaatataatattccgtaaccgctcagcccgcagttgcctttcctacctctccccgccgggatacagcgtggatctgtaaagtctcttttcctggggcaccggcttcccggaaggcattttctccggttcaggctccgtaccgctgtaaacccaggccgtttccccggaatagacgatcacatcctcctttccccggccgaacagatctccatgcagcacatagccgtcattggaaaatgtcaccgccgcctcaccgtttccgtcatacagcgcaggcatcaccccgccgcctctgcggtatgcaaggatataatccttcccgtcgccgttccagttggaaagcgcgtccacaatggtaagccatccgctggttttccggtcctccttccaaacctcccggccgcagcagtccaaaaggaacatcccgtcctttccgtcccactggcccttatagccgtcgccccggcggattctgtcaagccccgccacctgcagccccggctctcccggcaggaatttccccagcgcgatatgctgggattctatggagccgtcataccgccacagctcctccccatccgcgctgtacagacaggtcacgcttccgcccacggcgatttccggcctgccgtcgccgttcacatcgcctacccagagacagtccgcatgatcctccagctcatggcaggaccacaaaacccttccgttatgatccagcagatcatagcctgccatcacctcgtcatagccgtccccgttcacatcggccgcccagggaaaatgccccaggttcccttcatgggtccacagcacctcaaactgccggttcatcgcccacatatgaaaataccgatcctttaaaataatatcctccggctgctccttccccgtcagattggcaatgatgatgcagtcatgggcttcctctgccggcagctcatggctctccttcaccgaaccgtcggcgccgtccagaaccaggaactttttatccatcacacacaggatttccagccgcccgtcatgatcgatatcataaatctgcgccgggaaatccgagccgaagtttccaggctttcccgagctgtcgcccctctgccacagcagctctcccgtaagacggtacgcggtgacacaggtgatctgatgcggtacaaaacgatcgtcaatcccgctgtccgcctgtacaaatactacctccatcctgccgtccccgtcaatatcccccagaaggcccttgccgcctcctgctaccgaaatgtcaaaactgtttatcagcttcgcttccatccctgctcccttccgcctgctttaacaggcataaaatccacgtccggccccgctattccagccaggacagcacatccttgaaatcacagtcatccgcgtaataaaatttggtatagcagggctggttataacaattattctgccaggccaccccgcagcggtacattgtatcatgcatcagcgtaaaaagcttgtgccgtgtcagctccgtattggtataaatgcggatggcgctgtcatcctttttccggagcagcagctcctccctgaaatccccgaaaatatccgctataagacagggatttcccttcgtgccgttgtttgtcatagtatcctccggatccagcatcacgccatgggtattgtcattgattacccccggctgtaccgttccgatgtactgcgggctgtccaaaatctgcgtgctcatatccgcagcccagcggatattggcgttggttccgggcagcggcacgtccagcttattccccttacagtcaaacacctcgttcacccacacctgaagccccctcgtgttgggatcgattttccccaccatacaccggcccaggtcttccgtggcatattccccgaaaaaagcctccccgctgcaggcgtcgcgcaacgcaaagccataaggcacatgctccccgccctcaaacacattgaagatctggaagcccggccgatccggatcgatttttgccacatgcatggcgtccccgtgccccagcttgatgcgcagcccatccggccgtatgtcactgctgctgtaaagaagggagccgtcatggtctatcacggccgcgccgtatatgatttccatgcatccgtcgccgtccacatccgccgtggaaaggctgtggttcccctgccccgccagacttccatattcgggatccgtcccttccagcagatggactcctccgtcattaaaaggatttgacatgggcacatgcccactgtccacaaagaacgtttcccggaaccggttttcaaaaaaatcatacgcaactaccgttgtcctggtataatatccccggcagacgattaaatacggacgttccccgtccagataggccacgcctgacaggaatctgtccacccggttgcagggttctatccggggcattgcataatccccccagataagcccgtcatcctgccttcccacaggaaaacggatcgtctgcagctctttgccgtcccctgcaaacatggtcagatattccggcccttcataaatgaagccctcaaactgatccagcctgttcttttcacttctggagggcgcatattccctgataaaaatatcggcaagcaaatgcgcatcctcctttgataaaggataagacacccgtggctgcatgccccagcattcctccagcgtctgcggccattctcccctctttacctcagggcgctcctgccagagcgcgaaaacctccgccatatgctctctgtaatccgccgcactgcagacataattatcctcatgggaacagccggcctccaaatcctccggcagcatggtaatatatttctcctcttttaccctgccgtccgcaaaaaaggtggtcatcttcgtccccggagccgttttgacagccatttccgccttaccatccccattgaaatcatacaccataaactgggtataatgtgcgccggcccggatattgactcccatatccagccgccataaaagcgtcccgtccagcttatagcagtccaggtaacacctgcctgtatagcctttaatcgatacgtcatgggaattggacggatcccactttacaatatactcgtattctccatccccgtccacatctcccacgctcatatcattagcatggtacacatagctttcccctgcaggggtcacgccgccctccggacgcttcagcggcagatccagatattccttcgcccaggccttcacttcctcacagcgggcgccctcacagccgtccctggccggagacaccgcatacccgtccccagcgctgcccgtgctgtccagataattggtactcgtactgacctcggcaatccgttccccattcctgtatacataaaaatccgtccccgtcattccggtgtcacagtatccggatacttcccccagaaacagccgccagcttaaaaaaatcccgttttttaccggaacggcgaccagtcccctgttcagctgctccagctgctcgtggaacaccttttttaccggcgtcctgagaaccctgccgcattctccctccacgccgtccttcacgcaggacaccttcatataatgcgggacatgtgtcgccctatgcagcgtataggagcagtccgccgtctccgccagcctgcggtattccatggacggcgtatcgctgtccgcccagtaaacccggtagcactccgccccgtcttccggttcccaggcaattgttgccgaagaatccgttatttcctgtaatcttatttccatcccttttcccttccttatgtatttaaataagaaaaaaggaggctgcagaattcttccgaccctgcagcctcccctttatccggccatccggcctgcattactatttattttgtctgatctgcctgatacatttcattgatttcagtaatcagatccgcgccgccgcgctgttcccagactttaaactgctcctgtaagccattttcgtcaatctgtccgcagatatactgggttctcgccctgtccaggatatccttcaggtcggttcccacttccgcgttgatttttgagcttaccagataaccggaagccgggttaaataccgcaatatcaacgtttgcagccttaatcgcttcttcctcaatgaggcggtctgatttttccacggtcttcatatccggtaaatcaggcacataggcaacggactggttcaggccgatttccggtttttcctgaatttccttgtctgcaagcaggtcaacaatgtagccctcttcattgatttcatgatctcttccttccaggccgtagtccgcaaggattctcatatcctcatcgttcatcttgtccagataggtcaggcagttttccacatcctgctctgtcttggctcctgccttggtaatcaggaagcagcctgccgcaccggaggtagccagcgtatgaggttctccgccttcttccgccgcaatgccgccgatcagcttcatgcttgcattgccttcgcctgttacggaaggaatcccttctgtttcaaaataatcccatattcttctggagttgtcaagaacatccaggaacatgccgcactcgccattctttacgccgtcagtccaggtattggtctcacgggttgcccaatccttatagataaggccgtcatcatacatcttcttcatccacttcagggcttccagatattcctcggtctgatggacgggaaccagctttccgtcaacttccttccactggttgcctgcgccgaaccatgcctggatgatgtccagcggccctgtatatttgcacatgcacagaccataggtatcgtccttgccgtttccgtcaggatcgccgtaagtgaactgatacatcatgttataaatatcttcgatggtcttaggctcttccagacccagcttctcagcccagtccgcacggtagcccagcccgttacgtccgatgggcctggaacggtaaacgcctaccagctgaccgtccacggtaaatgccttacatacattttcattcatcttggaaaggttggggtatttttcctcatcccatacaaaatcattcaaatcccagaatgcgccgtccttggccgcctgtacgatattggctcccaggtcgcttccgtaggtgattaccatgggcatattcgctttgtccatcagggtaacgcccaggatatcgctgtaagaatcgttggctacccagttgaaatcaacattgattcccgtataatcctcggctgccttcagcacgtcttcggaaccaacattccccatggcttttccatagatatcaatgcacatgaaagtgatagtaggattttctgtgctttccgccgcagcactttccgctccgcctgcttcctgggaagccgcctgcgttccctccgctgcctgtccgctgcccgtttcagccttgctgccgcagcctgcaagcatggaaaccgtcatcgcgcccactaacaataaggataataatttgtttcgtttcattgttttcctcccttaaattataaacgtttatgttaaatcagcccttcaccgcgccgaccataacaccttgggtaaagtacttctgtacgaacgggtaaatcagcaggatgggcacggttgccactaccgtggttgccatcttaaccgctttttccggcggctgtcccatcattccccagtcaatcggggttccgtccgtattgattccgccggccaggaagataattcttctcagggcgatctgcactacctccttgctcttatcggaaatatagagcattgcgctgaagtaggaattccagtgccctaccgcgtaaaacagggatacggacgcgatggtgggcttggaaagaggcaggattattttcaggaaaattcccaaatccgagctgccgtccactctcgccgcttcctccagctccttggggattccctggaagtagttcttgataataatcatattgaaggcgctgattgcgccgggcagccaaagcgcccagaagctgttggtcagtcccagcgagctgactaccagatagctgggtaccataccgcctgaaaaaagcatggtgatgataaccatattgatgaaaaagttacgccctctcagataggaacgggaaagcggataagccagtgtagttgtaaaaaacatattgatggccgtaccgatgacggttacaatcaccgagtttttcagccccttaaacacatctcctgtccggatgatatatttataggcgtttaatgaaaattccgtgggaatgatgaagaacgccctctccgtcagttcacgctccgtagcaaaggaaccggccagtacatacaggaacggaaggacagtcaccactgcgctcaaaccgactatgaaataaatcaaaacctgtaccgcctggtcgccggggctccttttgattttggagccgttacgctgttttgccattgatatctccctccattttaatagaatcctgattcgccgcacatctttgcaatcttattggccgccagcaccattatcaggctgacaacggatttgaatacgcctgccgccgtcgccatggaatactgggccagcttgatgcctttattatatatgtaagtatcgaacacctcggatgccgtatagttcaggtcgttctgcatcaggaaaatctgctcatatcctgtattcaggatggatcccaccttcagaatcagcatgattacgatggttccgcggatggcgggcagcgtaatgtgccacatcagcctccagcgtccagcgccgtcaattctcgccgcttcatacagctccatatccacgccggccagcgccgccaggaatacgatggtgccgtacccggtttccttccatatattctgtcctacaatcaggccgtaaaaatacttgggcgacgccaggacatccggcgcagcgcccctgcccatgatgctttccagaatcttgtaaacaataccgtctgtggtgctgaacagctgctgcgtcagcgttgccacaataaccagggaaataaaatgcggtatgtaaatcagcgtctgcgacacccgcttgtacccctggcatctgatttcatttaacagaagcgacagtaaaataggcgccgggaaaaagaaaatcagactcagtatggaaatggacagggtattcttcaacagcatcgtgaagtcatagcccataaaaaacttcttgaagttcgccagtcccacccattcactggacagatatgcgccaatggcgctgtctgcgctgaagggtctgaaatcctggaacgcgatgacgattcccgccatcggcaggtaattgaacaccagcatataaagcacgccgggtattaatagaatatacagccatttgtgcgctatcacgaaatgcaggaacgattccttcttctgatagggaacagcggctgccttccctttttgtctgctcactaaaagccctcctcttctttaactattgggatgtggtgtcccttggttcgttttgtatagtaatctaactacacgcgtttttcaatgaggaatatctttccatttcagcaaaaataaaaagggaggcagaaagccccgttttacgggctttccgcctccctgctcctgtcaataatcattatctttcccgccggaaagcatatgattatcatcttttgttaccgtattttacaacatgattattttacagtcggcttttatcctcctggcctttatgctccttccggtattttcccggggtgctgtccacatatttgctgaagaagcggataaaattctgtgtgtttgcatagctgagctgctccgatatttccgcgatggaaagctccgtattcagcagcagctctttggcggtttccagtttttccaggttcaccagatccgtaaaggtcatattccgttccgccttcaggattttccagatatagctggggtgataattcagctgctcagcgcattccgtcagcgtaatgtcccccctgcgctcatgcacaagctccatgatccgcctgagtatttcggaggaagcctgatagcggtactgccgcagcgcttcgatggagggctggacgatctgggaattcatatagctcttgagcttgtcgctttcacagatatagttcagcttctggaaaatatcttcggaacggtcccgaaacacctggttggcagacaggcccgcgtccgaaagcacagccagcacggctatcaccagccggtacaggaaaaagttcctgtcatgacgggttatccctctgttattcaggctgttgatgaatttatccaccagctgcgccgcttcctcgcagtcgccgtcattgaccgctttggtgagcgcattttccataacataatcatagccgcttataataccgtcgttcctggcgatttcctcataaaaggtgatatcgctgtgatcccttggcccgctccccgtattcttgagcgtttccatacattcattgtaagcggtgcgcagatatttcagccccggaaatacctggctaacgccggaaatcagtgaacagccgaactccgtctccacaaactccgtaaactcggtgtggatgcgcattgtcttttcccgcagctcctcctgggtattggcgcctgtcagaagcaggatctgtccgttcaggcaaagcaccggcgtaatcagcccggcggcaatcccttccggcgccttcttcacaatggtcatgctcagcgcttcattttccagctcgctttcctggtccgtttccccttccagcatacacaccgccgtcaggagctggtataccctggcccttggcagctggaactgctcctgcgcccctgccaccgcctccggcgtcatttccccgcggatggtacggatgataaactgctccaccagtatcttctgctggttctgcaccatgagctgcaggctttccttcgtgtccacaagctgtaccacattttcccggatggcggaaaactcgtccatttcctccgtatccacccccgcaatatcggatacatacgcgttcaggctcttcaccggctgatacaggatgcttgtaaatatccggctgaggatgagcagaacgatgagcgcgcccatgatcaccagggagactcccaggattcttcccgcgccctccttcatctgccccagattataggccagcacataattcatgccgttgcccgaggtgccgctgatccggatcctgtattcaccgccgccttctatcttcaggttatctatgcgtttttcgtttttcagctcctccggatgcgcggaaaaataattttccagcacctcatccgaagaatataaggtctttgcatcactgctgaatatgcacagctcataaccggccaggttgctgtccagacgctgcctcagcctgggaaggttcagctgcaccataacgatctgatccacccggttcacattacccggcagcttcatgatcatctggaagccggaaacatccagcgttttgctctgataaatcccattcacataggctgatttttctcccacattattcatccagaacaacgtggagggaaactgcgccgctttttccagaagcgcgtcaacctgctccttgttcctggcctcgctcagccggtacatgccgttattcgtaagcacccaatcctgcatgatattgatgaaggcatagcttcccacatattcatccagataggtaggccccttcagcagattctgtgcctcattcagattgctgtaatcactgtagggtatgcttcccgtctccttcagccagctcatctgatcatccgtggaaatttccctgtaaaactgccggatcgaagaaagcgtaacctccacatcattgcagatctgggcttcaatcgcttccatggaaaggtccgtctgcctggtcacttcatccagatagactttataggatatgcttccggctatcagaagcggaaccaccgccatgagcagaagcagcaggaaaatccggttctgatattttccgccgtgcctgtccttccgtacggttttcataggctcactctttcccttcttccaaaaaggagaaagctcagtcaaagctttctcccttctgtttctaccagtgtaaattcagaagcccttacaccacgtaccagacgcgtttgtcggcttccaaaatatttgctgtgccaccttagagtgtgtcaggaatgaattttcaaacacgctctagtccgtaaagttatcgaagtagccctgcaccaggataacaggagttcccttgtcgccggaaccgctcgtcaggtcgcagagagaaccgatcagatcggtaagccttctgggggtagttccctgagaagccatgtctcccaccagattccccttcttacccttgattctttctgaaatcgcttccttcagcgcatctcctgaaagatccttgaaatcgttgtctgccagatattttagcttcacttcgttgggagttccttccaggccttccgtattggccaccgccacacaggggtcggcaagttcccagatttttcccacaggatccttaaaggcgccgtcgccgtaaaccattacttccacatgctttccggttttcataagaatctggttctggatatcattcaccagatccgtgcagtccctggggaacagcttaatggtgtcctccgtggatttattggagccgagcaggccgtatttttcattgcagccgcttccgtttacaggggatgtaagaatatcatccaaaccgcataccacctgggcgccgcactccttcaggatcctcttggtgcgcgctctcgtgtggatatcacagttgagtacattctttgtataatctaaaataactctgggattgttggcgaaaataacctcaacctccgcgccgcattcacggatcaggtcgctgtaataagccacataatccacgccggtgaaaggatgcctgttctcgccgaacagctccctgtatttttccagggaaagaacatcgctgtagggattcactccggcttcatccagctgatcctgggaaaccagcgcattgcccacttcgtcgctgggatagctgagcatcagcaccaccttcttagctcccatagcgattccgcgaaggcagattgcgaaacggttcctggaaaggatggggaaaataactccgatagtctctcctcccagcttctccttcacatcctgcgcaatcgctgcaacggacgcataatttccctgcgctctcgccacaatggattccgttacggagattacatctctgtcccttaactcaaagccttcactttccgccgcttccagcacgctggaaacaacgatatctgccagattgtccccttcacggataatcgggcagcggattcctcttgaaatggttcctactcttctttccataaaatatacctcttttgctgtttgccttttatcattcgcataaacgcgatcatacgcaccggcttcggttgcgaagcggccggcccgtcagaaggccctttttggcctctccggcccgacaggaagcaggcgcacaaaaatattataatataaagtttacggttatggaagcagaaatttatttattttctgtaatctccctcttactgtttcctttcatacttcaggaaatgatatgttgtgtcaaaataactctgttcatcgctttccgccgtaatttcccattcacctgaggcatccagattgggaaagtaagtatccgcctcataggaacggtcaattttggtcacatgggccgtgtcgcaataaggaagcagctggctgtaaacactgtcgcccccaatgacataaacgtcctttgtgtcataatttttcaattccgccaaaagctcctccacagaatggaccactatggcgtccttcacctgatattccggattccgggtcagcacaatattggtcctgccggctaatggcagccctccaggaaacgtatccattgttttccttcccagcaccaccacttttcctatggtttcattcctgaacattttatggtccgccggaatccttaccagaagatccccgcggtatccgatggcccagttttcatctactgcaactataatattcattttttctcctaaccgcccgccgcagcgggcctatcgcaaattaactcttaaatgagggaggccgggatatttttccggcccatgctgcccactgacagcctgactgccgccagccttcccccttctgcctgtttttcggttttcagatagcaatggggattccctgaatctgctcccctgtcacataattttccaccttcacatcatcccttgtgaactgataaaaatccttcacctccggattgagccagaacgaaggcgccggcagaggctctctttgaatcagttcctttataatagggatatgcctgtcataaatatgggcgtccgcaatcacatgcaccagctctcccgcctgcatgccgcatacctgcgccagcatatggaccagcaccgcatactgtaccacattccagttgttggcggcaagcacatcctgggaacgctggttgagtatagcgttcagcgtcagtctgtcctctccctttttctgggtcacattgaaggtcatgctgtaagcgcagggataaaggttcatctcatgcagatcctgatgcacatatatattcgtcatgatacggcggctgaagggattatttttcaaatcataaatcactctgtccacctgatccatcatgccttccttgtactgatgcttcactcccagctgatagccgtaggcctttccgatggaaccgtcctcatccgcccactcatcccagatgtggctgtgaagatcatggatgttgttggatttgcgctgccaaatccacagaagctcatccgtcgccgacttcagcgccgtcctgcgcagggtcagtatgggaaattccctggaaagatcataccggttgaccaccccgaacttcttgatggtataggccggcgtgccgtcctcccacctgggacggaccttctccccttcggtgctcgttccgttctccaggatatccctgcacatctgaataaatgttatatctgccagactcattctgcttttttctcctgtcctgtaaattctgttttgtaaaagctgtttcatgaactcagtttcttgaaagctgtatgctgaattctgtttttaaaatcagtttcccgttccctactgccatttatcacacagcgcattgatctgatccgccagcttcgccatatccttgtttgccataccctttccgttgcggataaccgccagaagcctctgcccggcggcctccagtctcgcatagacgctgtttgccaccgctgccctggccttcttttccctggctatcggcgccgcctcatattccagaaggttatggagcagatcaaaccgtgttccgctgaacggcgcataggtgtcatagccatattcatggcgcaggcattcggcaaaagaggtgcataccgtatcctccccatggacgataaacacccgctccggcttcttttcaaaacaattcagccactcaatcagcccgttcttatccgcatggccgctcattccctgaagcgccttgatttcggcccgcacatccacggactccccgaacagctttacctcctgggcgccctccaggatattccgtcccagcgttcccacagactgatagcctacgaagagcacggtacattcctcccgccacagattgtgcttcagatgatgcttgatacgccccgcctcacacatacccgatgcagaaataatcaccttcggcgtttcatcaaaattaatcgcccttgactcatcgctggtgattgacagacgcagtcccggaaaagaaatgggattgattcctttacgcaccagctccatagcctcttcatcaaagcagtcataaatatttttttcaaaaatccccgttgcctccacggccagcggactgtccacatataccggaaaattgccgtggtttttcaccaggcggtcttccttgattttccgcaggaaatacaggatttcctgggttcttcccactgcaaacgagggaatcaccacatttcctcccctgtcaaaggtcttctgcagcacctctgccagccctgaaatataatcaggccggtccgtcccatgcagccggtcgccataggtagattccatgatcacataatcggcgtccctggtaggatgggggtccttgatgagcggctggtttttgttcccaatatccccggaaaagcacagcttcttctgaattccgttctcctgtgcccacacttcaatgctggaggagcccagcaaatgcccgatgtccgtaaaacggatcctgattccgggacaaacctcaattattttctgataatcacaggggactaaaaggccaatggtgccctccgcatcctccatcgtataaggcgcttcatgtttttccgagctggcatgccgcttcgccttacggttcttccactccgcctcctgctgctgtatatgggcacagtcacgcagcataatatcacaaagctccgttgtcgcctgggttgcaaaaattttcccgcggaagcctcttgcgtacagttgaggaagcatccccgaatgatccacatgcgcatgggtcaggaacacataatcaatcatagcctcctgcaccggcagttccgcattttcaaagggatttatcccctgctccatccccctgtcaaccagaatatgctttccggccgcctccagataatggcagctgcccgttacctcatgatccgctccgataaaaattagtttcatgcatactcctgttctgtgctttccgcactcaggccctgattaagaaataccgcgctatccgctctctgcatcccacgctaaagacgcaatatcaccccgcaggaaactttcagaagaaaaaatttccatacatataaaaggcctggcggaagctgatccgtcaggcctttttggcacggccggcctgctatcattagtataacatgatatgcggccaccggcaattttatttcagcaaatccgctgtggtgaaaacttatggaatccattaatttattgcaggctggtccgcaatattggcggaagtatacagctggtaataaatcccctgttttttcattaacgcctcatgattgccttcttccacaatcctgcttccggataataccaggatccggtcggcgccgcggatagttgttaaacggtgggcaatggtaagcgttgtcctgtccgccgccagcttatccagggattcggagacaaggtgctcgctctcattatccaatgcagcagtggcttcatcaagcagcaggactttgggatttttcaaaaatacccttgcaatactgatcctctgtttctggccgccggacagtttcacaccgcgctcgccaacataggtatcatagccatccttcaggctctcgatgaattcatgcgcgccggcaagcttagcggccctgataacctcctcatgagacgctcccggcctgccataggcgatattttcatacacgctcccggaaaagaggtatacatcctgctgaaccacacccacactgcttcttaagctttgaagcgttacccttctgatattctgcccgtcaattaagatttccccctctgtcggatcataaaaacggggaataaggttgcacagtgttgttttaccgccgcctgaaggccccaccagagctactttttcgcccggcttaatggttatgttgatatctgacagcaccggcgtatgatcgtcgggatactcaaaagagacatgcctgaaggcaatctgcccatccacgtcatgaagcggaactgctccttcctcatcaaaaatatcgatgttggcatccatcagctcagtaaaccgttctatcccggtcattccccgctggaactgctccgcaaactctataatacgccgaatcgttgccaaaagcgtggttacatacattgtataggcaaccagatccgcaggtgaaatcaatccccgtatcataaaaataccgcctgcaacaatgaccaccacatacatcaggccgtcaaatatacggatcgtgttctgaaaggccgccatatatttataggtctgacgtttaatctccagaaatttctgattatcatcggtaaacttaccaagctccacatcttcatttgcgaaagcccttacgaccttatttccaagaaggctgtcctcaattctggcattcagctcaccaatatggtttctctgccgcttaaaggcttttcttacctgcaggttaaaataagaacaggaaaccgccattaccggaattaatacaaatatgataaccgtcagcagtgcattgatgcgggccagaatcacgaacgacacggccgccttaaggaacgcaataaaaaattcctccgggcaatgatgcgcaaattcagttacatcaaacaaatcacttgtgatcctggacattatctgtccgacctttgtgttgttaaaatagttatcagacagcttctgcaggtgcgcaaaagcatcctgccgcatatccgtttcgatagccgcccccataacatggcccgtataagccatgtaaaagctggccatgccgtcaataatccgcagcacaaaataaaccacgccaattgttataatcgtccgcacagtaagcgacgccagatcattcatcccgatattggtaatatagcgaagtatcaacggcagaaccagttcgcatactgtcgtgagcgcagcgcagaataaatccattaccatgatcccaacatatttacggtaatatgggataaatcttttcagcaatttactcgttttcatttccttttcttccccgtcattttatctttttttaaattccgccccagaataactatgtaccagggcatcagacgattattagtgtaacataaaatctttttcttttctataagaaatgcaagactcgataccgtatgccccaggcagggaagaactgctgcgcaatttagtaacagttcggctgaaggctggacggctcgccatttgtctggttattaaactatctcattgacagtcctgtgccgttatgctatttttcaaattaacagcactatggaaaaggagataccatggtcagaaaacttatttttgaaaatgaagtattgaccgcatacacacatcacctggctgccccggaacatgtccacgtaaattgtgagtttgtactggtcacgaatggaacagcgcttaataccgtagacggtatttcagaaaccattgtcaacggtgatgtttttttcctgaatcatcttcctctgcacagtattaccgaactcagtgacgatcatgagcatatcgacctgtatatcacctgcgaacagctgaaacaggtgtgcctgaagttatttaacgaagaattatatgattttttgatgaaagacgcttctgaaaaaaaatgcagcctgaattacgatgaattcaccgtaattgtaaaaaaagtacgtaaactggaagttaattatgtgcttgccaaagatgaggccatgcgggaaacctaccggaaatgcgtactcgccgtcatcattgaaatattgggcgttatttttgataatatgtatacccggcagattaactgccctgcctggcttgaatcctttttgcaggatatccagcggcctgaaatcttttccatgtcggtggacgaaattattaatctgtctttttattcgcacaccttttttggccagaccttcaaaaaatgctttgagcgaagctttaaatcctatatcgatgagctgcgctttaaccatgcaaagaaccttctggccacgacgcagttatccatactggacatctcactgtccgtcggctataacagttcttcgcattttatacacaaattcaagcagctttcaggcatcacccccctgcagttccgtaatataatacagcaccgcaaataatgcggtgctgtattacgtgaagccgcttcaactgctttccgtggtctttgattcacttttcatcctgtatgcaacttcatattcgcctgttgtcaaataacagatgttttcccgcacacatgaaaaaataggattatccgtatctgcaaacacgtcttgggaagccaggggcagctgcaggagggcctcacatccaaacggaaccgaaaatgtcagccttatattgtgcccgtcttcgaatttccaggcggatttccataatccgaaggccgaattaaattcacagcttacctgacccacacgaggatccaccaccggtgcaaagatgactttccggaatcccacagaatcttcagcctgtctgatccccgccatataggaatacatccattccacaacagacccgtatgcataatggttcaggctgttcattcccgtagaagaaatgctgccgtccgccaggacactgttccaccgctcccatatggtggtggctccaagcttaacctcatacagccaccccgggtaatcctcatttaacaaaagatgataagccagatcgttcattcctgctttcgtaagctcctccaaaagcatcggcgtccctacaaagcctgtctgcagatggttcccattggcttcaaaaagcgctttcagggccttgcaaataccttcccggtcctcacttaagctatagcgtaaagccagcagacagcttgtctgggtagtgacacagctaccctgtgggccgtaatattccttccggatattctgcaggatatcctccgctaaggcctcatagacttcggcatcctcttttttccccaggatctgcgccgctttcgcggtcagctgcgcgcttagccggtaatatacactggcaattaatccatcatccgttccgcccttgacgccatccgttccgccttccccgtcaagcgccagccagtccccataatgtaccgctctgcgccagccgtcgttttttccatctgccgtttggtttacagaggttatataatcaacccaggacttcatacagctgtaatgcttttccaatatccccgcatccccataaaaacgatacatattccagggaataattgtggttgcatcgccccagacagaggatgtgctgtctacatcaaaggccggcaccacgttcgggaccatacctgcgcggctgttctgctccgtttccatatcataaatatatttataatagaacgaataacagtctctgatataacacgccgtggctgaaaatacctgcgcgtcccctgtccaccccatccgttcatccctctggggacagtccgtaggcacatccacaaaattatccttctgcccccattccgtatttaaaatcagccggttcaataaaggatttccggtaaccagcttccccgtcccgggaagtgaagaatagatcgccagacccacaaagcagtcttttacggcatcctgcatcggcgtataggcagcatcctcttttttccttctcatgacctcaagagcttccgccttgtccttacaaactgtcttttcgattttcacatagcggtatccgaaaaaagtaaaatgcggaactatcgtctgttcagtcccgttggaaacgtaaaagtattctgagcctgccgaccgcagattgtcccggtaaaaattcccctgctgcagtatttcgcctgtctggatatggatcacagtcccttccggttcttttacccgcagtgaaaaaatacctgtgatattctgccccagatccagtacagtttcgccggcaggcgtatggatcaattcctttaccgggaattcttccctcaccttaaccggtgtgctgagcctggccgtcagactccccttcggcgcttcggtatatatcgcattgctgtccggttcagcctttctggtatcatccctccattctccgtcatagatattggagaaaacaatattggacgtccttatcttccagctgtcatccgtcccgacgatctgctccgtgccatcttcatatacgatacgaagctccgctaacagtttatacgaatcaccgtaatacccttttaccctgtctccggaaaatccgaatcttcccttataccatccgggccccagcatgacagacaatgttccgcccctgcttaacatatccgtcacatcataggtctggtactgaacccagctgttatagttattgcaatagggagtcagcagctctccgccgattttttccccattccacatggcctcatacagcccaaggcctgttatgtacaatcgcgcacggctgactttttttatgatatttatttctttatagaaaacagggctgtccagctcttttgacatgcggccgatccacttgcctttccagccttcctttccctttgcgctttcaaaccagtttacagcgctgctgcattcctcaccggcatctgtccggacgcccactgtccaataataccttgttctcggctccatttgcagcgaaaccggcgccgccaggggattgatatccgtctgatatcccgtatccaatatgacatcagccatcttttcatccgccgcaatcaggattcttgcggctgccatcttcttgccttcagcctccgtcactttccaggaaaacaccggattttcaaaatgatatcccaggggattttcataatgattcgttctgcactctgtaattttcattttaacgctcccttatcccttgactgatcccaccgtcatgccttttacaaaatatttctgcgcaaacggatagataagcatgatcgggatgagtgatataaatatttgcgcacagcgaatcgtcctgtcgtcaacaacggacaatatttttatttcatcgatactcaacaggcttaagtcccttttcacaacaacggtatataaatacgatgccagcggatagcttgatgggaaattcgaaaaaatcagcccgtcaaaatagctgttccactgtgttatgaaggaaaataaggtgagggtggcaatcgatggcttggcacatggaacatatacgcggaagcatgtaataaaatggttcgccccatcaataattgccgcttcctccagttccttcggtatcccccggaagaaattaatcataagcacaatgttataaacagaaagaatcgtgggaagtatcaatgcccagatggtatccatcaaatggagattggttatcagtaagtatccaggaatcagccctccggaaaaaagcatggtaaagaaaaacaaccaaacataaacgccccttgcctgaagctgagatttatccttcgacagcggataggcaatcagaatcgtaagaatcattgataacggcacgccgattaagaccctctcaacactttttaacagggacgtccagaactcctttttttcaatcacatattgatatgccatcgtcgtaaattctaccggccagagcgttaccttacccgcggcgactgccgttgcgctggaaaaagacattgccaggatagtcagcagcggaagtatgcacaataacgccagcaaagataaaatcatataatttataacgcaaaaaactgcgcggctcttttttatttttttcatatatatttaccctctgtccgcttttccggacattcattcaatatttggaaggtgctcccaacttcctacatcagaaaatacgataatctgaaaatttatatgcaagataataggatgtggaaataaatatggttgaaataatcgatttaaataatccaaccgctgtagcagcgccgtactgcgcgtcaatcagtcccagtctgtaaataaaggtatccaggatatccccgctttcatagactgccttggtatataaattgaatacctggtcaaaaccggcattcaggacatttcccaggctcaataccatcatcagcacaacaatcccgcggattccgggaagcgtaatatgccacaccttctgccagcggttggcgccgtccgtttccgctgcttcatacaggctggtatccactcccacaatcgccgccagataaacaattgcgctatagccgaaggttttccatatatccgttacaatcaaagttcctttaaaatacctgttatcccccaggaagaagatgctctctccccccagggaggttataatcccatttatgatgccggaacccggggacagcaaatcaatgaaaattccgcctaaaaccacccaggacaaaaaatacggcagatatactatcgtctgtatggtctttttaaatttaatatgatggacctcattcagcaataatgaaaaaatgatagggaccaacaggccaagcactattttccatgtggcgatgataaccgtattaaccatagcctgtttaaagcccggcagtgaaaatacgtatttaaaattatccaaacctatccattcctgattaccgaacatacctttgcttggtataaatttctggaaagcaatgacaagccccgccatcgggacatagttaaaaataagaatcaatactatcccgggaaaaagcattaaatgcagggggaattcttttttgaattttgataaggaatatttatttcttttatggtccacaatttcacctctcatagcttttccaatgattcgccgacggcaaagaacagcgtctgtactgttctttgccgcagcataatcaattctcagcggttattatttatttgaagaataccattcattaacctctgcggtcatttcaataccgccggcattcttccattcctcaaccactttatcgaatgcatctattttttcctgtccggaaataatcttaagaaaggtctgatccagcatatcatccagcgttgactttctggcagtcataacttccccgggcgctgaaacgaatttattataaacgggtgttgcattttcaggatcctgatattttaacagaatactctgtccgccttcttcaccaaatacgccaagccatccccacatggaatcatcaccctgcagcgccttatagcaatactcccacatggaatattgttcccctgtcaggtcaccgggctcccctgtttttaaaggctccgcaattgcttttgtagtagcctggtttttgtcaggagtactcgttattccaaccggggcgagcttccaaacaccttcaactccatttccgggatttgcatataccgtatattcatttttttccggatccagcactttttcgcaatacagattcattaattggattaaagcctccggatgctcacagttcttacttaccacgtaccagcccgtggtcgccatttcaattccaggcgcggccttttcatcggctttttccatcggtatcatgaacggcttccactcagcttcaggatttgcattcttaaccgtctggaggaaatccagcggtgttgcatgaaatccatacatagcaccgcattttccgttaacaagcgcttccgctgccttctgattatcattcacataaaattcattatcaatcaatccatccgcatataactcggacagagtagttaatgcctgcttcatctccggtgttgtgctgccataaaccagactgccatccttgtcttcaatccaataggtgggatacgcatggtatgcattgcaaatacccttgatatcaaactgattcccatacagatcattccccattgcaagtccgacgccgccttctcccgcatagtccttgaaggtactcaatacttccttaagctcatcaatgctcgcaggtgcactcaatcccaatgcatccagccaatcctgacggagccataaaatctgtgccctttcaatatcactgtcggaaattggaagaccataaaccgccccgttataggtaacagcatcaaacgcgctctccccgacagtttcatacagctgttttacataatcacttgcatattcatcaatataaggttttaaatccactatcagatctgcatccaccagccgtttcagatcctctttccccacactcgctatgtctggtatttcaccgcttgaaatcgcagcattgaatttttgcttataaagatctccatccgatgcgatccaaagatatttaacctcatatcccaatgtatctgcgatcaggtctgtccaaatattatcttcatatgtactgccctccatttttgcaaaaacacttgattctattgttgaatcctgtgatcttacaaaggtaatcggaacaaggccttccgtctgtgcggcgccctccccgcccgccttctggctttcctgcgttttttccgtttccacatttgccggggtgctgctgccgcagcctcccagcgcagagattgccagcatggtactcaatacgattgctactgttttccttttcattttaacctctccttttttatattcagctgtggcgtcccatccccatgcgggacaacagcaactgtttcctttataattttgcttcgtttttataaatttactttactaccaaacaagctttttatctgtcgtatttttttccaataatatcgttttttaacgtaagcttcccatgacggcacgacagaaatcaagagggattgttccttgcttttttcaaatcataaaagcccccgctgcaggcagcggaagctttggtcctcgcgacagccgccagatatccatgcaagcatgactgcctggctcgtttcccgcgtacataaacgtgcgtttttttgcttacagctttatttcaggcttctgcgcagaactttcctttcatacaaaaaaaagccccgttctctccataagaacgaggccccgataccattcacataccagcttcctgcacataagcgcatgctgttttgctttctttacctgtttaattttatagattaataacaccgtcaaacaatttttccctgtccagaaacagaaaactccgattgctttatttccacggtcaaatagtcaaaaggatgctctctacacttgacgcctgccgcgtaggatactatgtgccagtggcacatgttttgtaccgactgaagcagaacgtagatcaaatccaccgctattcacagcgtttcaattttgatgcccgttgcctgtggcggggtgtttaacttatcatttattattactgcgctttctccccgtaaagctgcgcacggagataggcgctgtttttatcaaaatccacctgcagaacatccatgccccggatgcttgcattcgaataagtcccttccagcgggatgctctcctgcaccagttcataggtgagcagcttacccgccatcaggctcaggcgcatacattctgcctgcgtcaggttggttgtcaggttcgggaacaggccgtcaatcaggccgcccggattcgtcaccgcggctaccggaagctttttcattacagccgcaagcaccttcctctgtctctccgtcctgccaaaatccgtaccaataaaccggttgcggctgtaagcaagcgcctgagggccgttcagatgaatcgtcccgctcagtgaagtatccagataatcggtatctatcggcatgccgcgaagctcattatactcattcaggtaagcgttgacccacttcacttcatcattggtcagctccatatccaccccgttcaccgcatccaccaggttggcaaatgcctggaaattcactaccgcataacggttcacatcgattcccagattctgcttcaccgtctccagaagaagctcgggcccgccgaaggaataggccgcgttcagacggttgccctctcttcccggaatatccacatacatatcacgcagcagggaggtcatatgaatcgtcctcgtcttatcactgatggaaagaagtatcatggcatccgatcttccttcatcccctgctgtccgggaatcgcttcctataagcaggatgttcaccacaccctgttccttcagcggctcacctgccagcgtttccacacggccgtacctcatcttgccatatatatgtccaaccattacataccagattcctcccagcaccgccagaagcacaataagcagggtgagaaatttcctgaagcctgactttttctttccgacggaatttttcttttttccggaagcacctttatttcctttcattccgccgcccttttctttctcaggtttctgcttcttcgggggcttccccggttccggcccggtccggtccgggaaacttgggcccgcgttcttacgttttgcttctttcttcccgtgtcttacgtatctttcctgcgggttgtccccatactcctcctccggaaatgggtccctccgataacgccggttggtatattcctcttcatgggattcatcttcaggatattcattgcctgaataatcttctgcagaataatcttcatccgggtattcgtcttcaggatacttttcttcggagtattcttctccgagatacccatcttcgggatactcatcctccggatactcttcttcaggatactcctcctctgaatattcatcctctgaatactcatcctccggatattcttccccggcaatataactgcgttctgtattcatgctttcctgtttttcatacctggccacttcccgatccagaaactgctcaaggcttctctggatctgctccatttcattaccggattctttacccactggcagcctcctttatcttccgcggcggaaccgccgcagccctatattaattccgctccggccatgcagacagcaataagccctgttatccgtgacgcaaagcatgtttggaaactcattcccatcgtctgcaagcctgctttcagcaaaattcaaacacgcttagtatagcatacaacctgccgaaaactgaatcggattcagaaagatttaagaataaattaaacggcaattaaaaaataacggctgtccgatttccggaagccgttatctttttgttctgtgagagcgatagacggggctcgaacccgcggtctcgaccttggcaaggtcgcgcgttaccaactacgccactatcgcattctgacatcactcaatatatccttttgtgatgtacctgcccgcctgtccgacgggcaagtattactatacaataaacttaatttgttgtcaactatatttttaaatttttttatttttttatttctgccgcccggccggtaccattattacggcctgccgcctgctgcctcagggcatccgccgctccgctctactcctccagcgtccccgcatacttcacccggtacactctcttgagcgagtcattgatacggttttcatcaatcgtcccgtccttaaccgccgccacaacgccttcgtacgccttcacgaaatcctccggcataagtatcatatccgcgcctgccttcaaagcctttattgccgcctcatccgccgcataatattcggaaatggcagacatattcatggcatctgtaattacaatgccgttataacccaactgttttcttaaaatatccgtaatgatcttctcattcatggacgccggctccgcatccccgtccgtcagacccggcgccgaaatatggcctaccatcaccatatccgtcccggcatcaatcccggcctggaaaggcaggaactccgccgcctgcatttcttccagcgtcctgtccgtcttcacagagccttcatgggaatcccccgacgtatttccatgtcccgggaaatgcttgatgcaggcgcttatccccgtatcctgcagtccctgtacggcgcttgcaaccatctgggacaccactgccggatcgctgccgaaggctctgtccccaatcaccttattgtccggattggtcaatacgtccgctatcggcgcaaaatccagattgaagccatattctccgagataagtgccaattgtctgtcccgccgtatatgcagcggatgcgtcaccgcccgctccaatatccgccatcggtcccacattggccagcttcagctgatccgccactctggcgacactgccgccctcttcatccactcccaggaaaagaggataggtcgcataaccggccgtcttggaaagcatttccttcagctgttctgcggactgaatattctgcgcaaaatatacgaggccccctaccggatatttcttcagggcctcctccgtacctgaacctgcctgaaccgctttagttactccggtcagctgctccggcgtaactatgaacaaaccagccaccttatcctccaggctcatattggctacacaggattccaccagttcctccagcagttcttccttagatggaacattctcaaccggcgtctccgtctgtgcttctcctgtttcattctccgtctgcgactgcatcattgcttcctcctgagccagagattctgcctgcgcctgagattcctccgccgcttttttctcctccatggcgctggctatcgaccggatccccatcactccgcccgtcacgattccggccagaatcagcactgccacaatatatgatataatctggtttctgacccttctttttctccgcatatctctccggttcattccaatacccctttacataacttaactgattcattctttgcagccgcctgatttagagccgccgaagcagcgccccgccagcaatatgagagtcctcaggcttatgcgagctctgaattattattcttgaattaccaactctggattttctgttttaacagtaccacaaatagaagcgggtatcaatcatttttcattcttgacacccgctcctaaactatgctatccaatggcctcttcctccatttttctcctccgcttttctttccactcttcctactctttgtactcgtgtactgcaacggtattcatcttatttctatgatgattcttcgtcactcaagtaagtgtactcgttctgcttcggtccttagcatcgtccttaaagtatatattttattgttcttaaagattctattcttttctctcccggatttctttaaaatgacggctctttttgtttatctgactgccatctataataaattacttctttcaactaaggatactgtttccttggctctcagaaccttttctttaaactaaagatgtcggcttatgtcgtttctttaaactaaagataattttctttgctgtcagaaattttctcgttctcaaaagaatctttttttacagttaccagcctgtcagataaccacggttccttcaatctaaagtccttctcgtgaaagaaaatccttttctcttatcgaacaatctttaaggctttccttattaagttgtgtttcgctgtctgattatttctttaaaaattttgtttttaaagattaaagtttatgttttcggtggtctgtaccttcctttcctctatatttttttgtttcttccttgtttgtgacttcattatatctgtataaataagaattgtcaatatatttttcgtcttttttaattaaaaatgttatttttccattttcaataaaaataagctttaattatatgtatattgtatataattatacgaattgtctgacaatttaatttcttgttcttctattccctatccccacataaattgacaatgctctttttacgccttacactatcattaataacaattgccgccggttatacggcggcggaacggagggttacatatggacaacagacaaacagcttttgccagggcctgtgaggggattatcgccaatctgaaaaaaaggaatatggaagggtactttttcgaagacagtgcttcctgtgtcagggcaatacttgagatgatgccggaaggcagcgttgtatcctggggcggaagcgcttccgtacaggagagcgggatgatggatgcgctgaagcagggaaattaccggctgattgaccgttctgaagccaaaacaccggaggaacagcgtgaaacctatgcccggaccgttatgtccgattactattttatgagcagtaatgcaattacctatgaaggggagcttgtgaactttgacggaaacgggaaccgggttggctgcctgattcacggccccaggcatgtgatgctcattgtggggatgaataaggtgacagcttccctggaaagcgccgtccagcgtgtccgcaccatggcctgcccgcccaatgccgtccgcctgaaccgccaaacgccctgcgcagccacggggaaatgcggagactgtctgtctcccgattgtttctgcaaccagcttgttataacaaggcgcagcggccatgcaggccggattaaagtattcctggttgccgaggatctggggttctgaaaaagctgaaacagatgcagaataaatgagcgcagccgcggcatctgaatgcccgcaggcacaaaaagcgtgaaattccagccgtgagccatggaatttcacgctttcttctttttagactgcctgtatcaaatccgtatgttaaatctgaaccagcacaaacatattataaatcgcacggattgccgtttcaaagtcctcatttcttacgccgatgatgatattcagctcgctggagccctgatcaatcatttttacgttaacattggaatgggcaagggcggaaaagattctgccggccgttcctcttgtggatttcatgccgcggcccacaactgcaataagggccagatcggattcaatatcaatggtatccgggtgggcaagacggtggatggcggacaccaccttctgctccttatccataaattcatcctgatgcacgaaaactgtcatggtgtcgatgcctgaaggcacatgctcaaaggaaatgccgctgtcctcaaaggcctggagcaccttgcggccaaagccgatttccgcattcatcatgtctttttcaatattgacggagcagaagcccctctttcctgcaattcccgtaatgacgaatttggatttctggcaggtgctttccacaatccatgttccgttatcgtccggcgcattggtattgcggatattgatgggaatcccttcctttcttacagggaaaatagcgtcctcatggagaaccgttgcccccatataggaaagctcccgcagctccttataggtgatggtatcgatgcctacggggttggggatgatacggggatccgcaatcaggaagcccgaaacatcagtccagttttcataaacctccgcatgaacagcctttgccacgatggatcctgtaatatcggaacctcccctggaaaaagtatggacagttccgtccggcatagcgccgtaaaaaccgggaattaccgcatactcttctttttccagtcttgcggacatcaccttatccgttttgtacggatcaaaattcccgtcctcgtcaaagaaaatcacttccgccgcatcaataaaagtaaatttcagataggccgccatgatgatgccgttcagatattctcctctggaagctgcataatcctttcccgcttttttcttaaaattatctaaaatgactttgaattcttccttcagggacagttccagggaaagccccttgataatttcctcatatcttgcttcaatcgccttcagctgatcctgaaagggctgatcctcttgtgcggcggcatagcaggcatacagcatatccgttaccttggtatcctttttgctgcgtttcccgggagcggagggcaccacaaatctcctttccttgtcagaattgatgatatcgcctgcctttataaactgttcagcgctggcaagggagcttcctccgaatttcacaaccttcataataataacctatcctcacgcctcctgatacggcgtttttttcctttcttttttatgctttgggaccagaccggcggccgggcgccggcaagggctttttacagatgcatcttctgtttgatttccaggaatttatccataagcttatacccttcagggataaaattcccactcaggatagcctctgcttcattataattccagtcattcttctgcgggctggtgctgtcgtacaaaagatagggcacgctttccgccgtatgggtccttatccttatcggcgtgggatgatccggcatgaccagaagcctgtaagcctctccgctcctgtcaagggcttccgtcagcggtccaaccacccttgcatccagatattcgatggcctgcagcttcttttccacgctgccctggtgtcccatctcatccggcgcttctatatgaatataggcaaaatcatagccgtcctttatcagggcgtccaccgccgcctgcgtttttccttcataattcgtatgtaaaccgccggtggctccttccacctgcgccacatccatccccgcgcccacggcaatccccttcagcaggtcaaccgcggatatcatgatgccctttttcccggttttctcctggaaggagggaagtgcgggcctggttcccgctccccagaaccagcagcagttggcgggattcaacccgtttttcctgcgttccttattaataggatgatcctttaaaatctcatagcttttttccatcatttcataaagcattctgtcagccggcagataaggggctatctccctgcccagcacatcatgcgggggcgtcagctcttccacctcgccgttctgccaaatcaggcagtggcggtagctggttcccacataaaaatgataaggatcacgatccagcttctccatcacggcatgaagcagcaccgcgcaatcctccgtactgatttccccggagctgtgatccaggattctccttttggaaaaagggattccctcttcctcggaaagcgttactatattacaccgcatggcgatatccgtatcctgcatgggaaccccgatgctcaatgcctccagcggagaacggcccgaataatatttcctgggatcatagccgattaccgacaggttcgccgtgtcggagccgggcttcataccttcaggtatggtgcttaccatgccgatttcggattttttgctgagcgcatcaagcgccggcgtctttgcatacgataaaggggtttttccgttcagccgggagatgggctcatctgccatcccgtctcccagcaccaccacatatttcattcattcctcgattccgccgcctgccgcggcctgccatacattctagtcctcttccaggcggatccggctgataaatccgggaagctccgccgacttctgcgcaaattccttttccgtcataacaggggtcacaaagccgtattcaccggttattccctccgcttctattttatccacatctccgaacagcttctttaccgcatcctctgagccttcggaaacacgcacgaagaatttccgggaagcatcctccacgctcttaagggaaagcttttcttcctcccagatacagatgatgtgcttgcgtccgtgcttcgcacagtcaatcacatcggaaacaaccgcgctggcggtaggcagctttccggcgcctcttccgtaatacatggagtcacccagggtattgcccctgatgaaaatagcgttaaacacatcatttacaccgtgcaggggattcctctccccgatcataaagggcgccaccatggcataatattcgccgtccagctcgcggctcttggccagaagcttgatgaatttattcatctttttggcatagaggaaatcctcttttgtgattttcgtgattccttctgtgtaaatatcctcgtaacgcacggttttcccggtcatcagggaggaaaggatggcgattttacggcaggcgtcatagccctccacatcggcctcgggattgcgttccgcatagcccttatcctgcgcttccttcagacaggaatcaaaatcgcttccctcttccgccattttagtcagtatataattggtggttccgttaaggataccgttaatcagctcaattcgttctgccgtaagcgctacattcagcggacggataatggggatgccgccgcccacgctggcttcaaacagatagttgcattcattctcacgcgccgtgcggataagctcggccccatggtttgccaccagctccttattggaggtgcagacgctcttcccggccttcagggcctgcatggaaaaagtgaaggcaggctcgttgcctcccatggtttcacatataatggatacctcggggtcgttcaggatgatattgtaatcatgcactatcctgtcttcataaggatctccgggaaaatccctcaggtccaggatatatttcacatgcagctcctgtcccgcccttttgtcaatgacatccttgttcgtctcaataacttcaacaacaccgcttcctaccgtaccgtatcccagaactgctacgtttatcatatctcttcctccgtcttgccacttttatgaaattctattgaaattctattccttcgccaatatcttgacgttacggacgcctcttcgctcttccatggtttccagcatcctggaaacatctcccgtcgtgctgagcacctggacgctgatgcttaaggatgccacgccgttaatggggatactctgatggattgtcagaatattcgccccgaaatccgcaattaccttcagcacatccgataaaagccccggctcatcctctattgacatggacaacgtaattgtggtaccctgtgcggtatcatggaacggaaaaatatcatccttatatttgtaaaaagagctccggctgatatccactctctccaccgcatcctgtatcgtcgccgcttttcctgattccagcaggcgctttgcctcaactaccttcagcaggacctcaggcaccgccttctgttttactacataataatcgctcgtcttctgcatattcctcatcctgtatcccgggctgttttcatgccttcaggcccttatcatatcatgtctttccactgcaaacaattgtgtgtcaccgagagatattgtagcatagggtttccgggaaagcaacaaaaatttacaggcggattgtacttttagaaatacaattcgcctgacactgcataaatatgcattcaattatacattacagcaaaaacagcagcaaatatctcagcaggagcaaaatcagcatatgcaccggataaatgagataaaagaaatatttatgcccctttatatatctttttccattgcataaatagatcagggggaatacggcaatgcagaagccctctatccccaggctgtccaccgcattctccaggctgcgcagtcccagcggaacgccgatgaaataagaggcaagaaaaagcgcaggggacaggatacactgcaggctcctgtccccgcgcagcaaatacagcacaacaatgaggaaaacaccgctgtatccatagtccgtatgcagcagtccggccgcagtcattcccgccgccacagctgcggcgctgcacagcccgccaaaaacctgtgacttcagccgctcccggcactgtcttaccgcagccatcgtcagcagcccggccagaagcgtccagaacacattctggtgcgccattgtcatttttccataaaacagaagatcaaagggagcctccgacaaaagggcaaacaggaaaagccgcagggcatacctggccacgctccttgtatgcagaaagccctgcagcagaagatagcaatatatgggaaaggacagacgtcccacagtcctcagaatctgatacgccgcatcacagtattgccaggccgcgccgccttcagggatggtgtgaacaaggaaatacttcagcagcccggcccccacatggtcaagaaacatggtcacaagcgccaggagcttaagcgcatcctctgaaaacatgccgtttgcatcccgcaggtttctcaatacaatccgggtgtttcctttacttttcataattacctcaacttaaaaataacggggcatgccgccccgttatttctcctctttttattacacaagcggatacttgtccgtcaatgtctgcacaatcgctctcgcttccggaatctttgcctcgccgcccttgatcaccagtgcaatcgcttctgcgatcctgtccatatcctccgtattcatgcctctggaggtaacggccggcgtacccagacggacgccgctggttacgaacggagacttgggatcgttggggatggtgttcttattgcaggtaatatgcgcttcgtcaagcagcttctccaccgccttgcccgtcagatcaaagttagtcagatccacaagcatcaggtgattgtccgtgccgccggatacgattttgattcctctgctcatcagccccttgcacagcgcctgggcattatcaatgattccctgctggtacaccttaaagtcgtcactgagcgcttccttaaagcatacggcctttgcagcgattacgtgcatcagggggcctccctggattccggggaaaatagccttgttaaaattatacttctctgcagcttccttattgcagaggatcatgcctcccctgggtccgcgcagcgtcttatgggttgtagtcgttaccacatccgcataggggatcgggctgggatgaagccctgcggcaaccaggcccgcaatatgggccatatccaccatcaggcaggctcccacttcgtcggcagcttccctgaaggctttgaaatctatggttcttgcataggcggaagcccctgcaatgatcattttaggcttgcattctctggcgagctgtttcattctgtcataatcgatgaagccttcatcattaacgccgtaaggcacaatgttgaagtattttccggacatattcaccgggctgccgtgtgtcagatgtccgccgtgatccagattcatacccataacggtatctcccggattcaggacggcaaactgaaccgccatgttggcctgtgcaccggagtggggctgtacattggcataatcacagccaaacagcttcttcgcacgttcaatggcaaggttctcaacctcgtccacacattcacatccgccgtaatatcttttggccggatagccttccgcatacttgttggtaagcacgcttcccattgccgccattacagccttgctcacccagttctcggaagcgatcagctcgatatggctgttctgcctttcctgctcatccacaatcgcctgcgcgatttccggatctgtcttcttcacttcatccagagaatacatccttttacctcctgcataagtatgtccgctacgattcatctgttgcggcgcgttaatatattaaattgcgttgggatgattatagcatacattccattaaatgcaaatataaaattattcttatacttttcttaagttgccctttttcactttacttgccatttcatttctgctacaatacaaccttagaaaatcagtaattatgaggttacaggacagcctccggaggccggactgtaatatttgagggaaagccggggagattcatatgtattcatttttggtaaatcctgcctcccgttccgggagagggcagaaatactgggaacggataaagcctgtccttgaggaaaggaagattccttatcaggtctttttttcaaaaggcccgggcgacatggttaagctttcccggcagctgacttcttccctgtctccggaaggagaggacgtccaccttgttgttttggggggcgacggaaccgccaacgaagcggtgcagggaattgcggatttttccaggacgcggttcagctatatccccactggctccagcaacgatctggcccgcgatgcaggcatcagccggaatcccctggaagccctggaacgcatactctcctccgcccgcgaacaacggatggatgtgggttttcttcattataatacagcatacctgcccgaagcctcccggcctgcggacgtaccgccggaccgccgtttcctcgtaagctgcggcatcggctttgacgccggcgtatgccaggaagccatgaagtcacgcatgaaggatttcctgaataaagtaggtctgggcaaattaacctatctgggaattgccctgaaacagctgatgcgctcaggaagggacagcgctgagctggttatagatgaaaacagcccttcggcgaaaagcatccgcctccccggcctgatgtttatcgcctgcatgtcccactgttacgagggcggcggcttctacttctgccccggtgcggatgcggcggacggcatgctggatctgtgtactgtcagcggcgtgcccaaatggaaggtgctgcttgtccttcccaccgcttttcagggaaagcactatcgctacaatggcgtggagcgttacggcggccagaccatacatatccgcacctccgctcctttatgggtccataccgacggcgaggtagcctgccgctcggacgatattacggtcagctgttcaaagcagctgctccgtttctattattaaacgtagcaactcaggcctgcgggaatattgttgcaaaagccggcttataggaccgcttttccacctgcattcccatcggatgaatatccgatgcttcctgagtggcagagccattcagaaagacggccgtcctgattacatagtaactatgaacattaacgctaactgctaatccgatcctccccgttctttgttccgtcggcactgcccacatggaatgaacaccagggaccttcaaagaggcgaatattatgaaaaacatctatgaaaaatacaaacacattcttccctttgcattatacttcttcgtatatatgacctggttctcctggctggagcaaagacatatatggaaatatcaggtaatccatatggcggttgacaactatattccttttaacgagattttcatcattccttatttcctgtggtttgtctacgtaccggcagttgtcctgtacctggctctgcacaataaggatgactactacagaacagccatctttctctgcaccggaatgacggtattccttctggtctccacctttttccccaacggacaccatttaaggcccgccgtaatgcccagggacaatatctttacccagatggtcgcttcgctttacaaaacggatacccccaccaatctctggccaagcatacacgtatataactcactgggcgcgcatttcgcactctcccgctcagaactgggcaggaaaaaatggctgcgcagaacctccggggttctctgtgtttccattatcctggcaaccatgttcctgaagcagcattccgtcttcgacgtacttaccgcttttgtcatggccgcagccatgtacggaatcgtttaccactacgacgtactcatctacctgaaacaatacagaaccgcaagacgtgctgcaagagccgcgcataaaatccgctgatttatgatttatgaaaaaagcttctatgcaaaatatttaaagcaaaacaatacgcgaggcaggtaaccgaccagattacctgcctcctttttataaccacatcccccatctccccgcccgctcctaaacaacttcctccaccacccttgcccttccatccttttgcccttccgcccttttgcccttccgtccccactaccccagccgtggcggaagaaaaaggcctcccggaggggctctccttgcggtcctttgccggagacggacagggcgtcgggcaggtgttggcagcggctgctttttagactatggagatgagacttaaaattgtggaaggctttcctgacacaattttcgcccaaggctcatcgcaatgcccagtctaacagcagcgctgccaacacctgcccgacgccctgaccgcctccggcaaaggaccgcaaggagatcccttccccgggaggcctttttcttccgccacggcgccgctctaattaaatttgaagaacctttgacagagcttatagccctccacagagatcttcctgccgccctttcccggcaggttggtataactgcccagtagcccataccgcagcctgaaaaacacgaacggatccttctgcttgatatatttccacagctcgtttttcttttccagattctcatccgttccggaacaaatcagcataattgacgacaccgtggtaatgatatccaggtagttgagcatataattgcgcagcttcttatgcgttgccagaaactgctttttggcagtcacataatccaccatgattttatttaccttcagctgctgatcgattctcccgatcatcaccttttcatttacggactgatccgcgcggccgatataatacctgtaaaaattcacatccatataatacattttcttcacgtacggcagcggctcaaacacgaaaagattgtccacataaaaagtatgctccggcagcttcagcccgcagtccttcagaagctttgtacggaaaatgacggaatgcataaggatgtactgtcctttatggaaccggtgcacatcattccatgtaaaaatctcgtcctccgggagcacatggcggtaacggattacctttttgcgcttttccccttctttttcatatacatagttggcgatcagcatatccaggacttcctcgccgcctgtaagctccgtaagcttatcaaggatttccccataagccgtatcagaaacccagtcgtcgctgtccaccaccttgaaatacagccccgctgcattctcaatgcctgtatttaccgctgagccatggcctccgttctccttgtggatggctttgactatggcaggatacttttccgcatattcatccgcaatcgcggctgtggcatctgtggagccatcatccacaatcaggatctccacgtcctctccgcccggaagcagggaatcaatacatttcctcatatatttttcagaattataacagggtactgttatagacaacagtttcatatctgctcctatctggcgcctggcgcctgcgcggtttcacccgcgatcttttcagaaagggagaatctgtttcgcttttgtcccttcctcacttcttttcttcaaatttatcatttcccagccgtatctgcagatatccggtataagccgcgtaggccgacggaatgggatattccttttccgtcagggaaggctcaataaacagcagtccctcctgcgttccccctacgggctccagttcatccacgcgtaccgcatagccaatcatatcccattccctatgggtaaaaacatgtctggaatcaggaagcttctgtatcctcagaggatgcagccccttttctttaagcagggcaagtacctcctcctggctcagatgcccttcctccgacgggaattcatacattccggccagcattccctttgcgggccttttcctgatggcggctctcatggcatcctgaatgacaaggatcgtttttttctcaatacttcttgccttctttgccgcctttttaggaaattctgtttctctgccctctatgtgcgccttacaggaggcttcccatggacactccccgcatttcggcgcgccgttgggaatacagacaatggcccccagctccatcagcgcctggttaaaatcccccggccgatcctttggcattaccgccttcagatcctcttccacgctttttctcaccttatcattgagcatgtccctgccgtccgccctgtatctggatattacccgcagcacattgccatccacagccggcaccgcccggccatatgcgatggaagccaccgctcccgccgtatagctgcctatccccggaagcttcagcagctcttcccggctgtccggcatccggccgccgtattccgccataattgcctgcgccgccttctgcaggttcctggcacggttgtaataaccaagtccctcccacagcttgagcagcttgtcctcaggcgcctgcgcaagctccggtattcccggaagcgcctccataaaacgctcaaaatagggcttgacggcttccactcttgtctgctggagcatgatctccgaaacccacacgcggtaaggcgccggattctctctccagggaagcacccgcctgtgtccatcataccatttcaacagcggcggcgcaatatcgcagagattttcattgttatccgcttcgcatacggcaggcccgtctgccatacttcgtcctttggcagtttgaatgaaacattcctgctttttggcttcgggtttcagaacaacggggatctcataactgatttccatgctgtcctgcgtcacatgacagcctctggcgtaaatagcaacaccggcctcctgcgcccgttcaagcgcctgggcaaaagcaggctgcgtttcccagttaggcgtaaaacggcggattccttccatctgtaccacgaacagtatccccgcttcatatccgttttccttagcctggatgagttcctccacatgcttgagggcacgcaaagagggggcatccggaaacagcgccgtcctttgcgtttccaatgttacccccttaacctccagccacattttcacagcttccgattccacatagaaatcaaaacgggaattcccgtaagtacattccggctttatcagctttaccggagccagcaggcctcctgatgccagccattccccggcagccagattcggtgcagccgaatccatattgacaagcagcccgcccttttccaccgccaccaaatcgtaggcggttttccgtccggggttgccgcttttttccagatagactgtgacgcccttttgcagcagttccctgcatctgccggtatttttaacgtgtactttctcctgcctgccgtcaatctccacataagcgataaaacggttcggccgttctataaaggttcctttcacgatatctttatatttcataaaaacagttattctcctgactgttactgctgctctttctactgctgccgcctttacccggaaaaaattctatctgagcctgttgcactcatatttttccagagtaacgatgcagttcttaagcgtcatgtagcgctcctcaagttccccatcttccagctccagatccagggaaaccgccatggtattgagcatatcgtccgtgatacggctgtgcagccccaccagaatattcagcttatcctcataggtatcagcatccaggaactctaccagcatggggtccagattaagttcttcttctgcctcttcaggagaatcctccgcacatgcctttggcgagccggtttctccacccggcgctccagacggcttacccataatctggggcacaagggtgaaacggtattttgcctgtacctgaggatacttttcgtgatcaacctcgctgacaaacatggaaagaggtcttacaaatacctgaaaatcaccatacagggcctgatacacaaccatagcctctccggtctccgaatgcgtggcaagcgtgactatacgatagagatttcctttaaaatgctgataaatttcatttggttcggggattctgtccatttcgcttctcccatctgcttatacagctccgcccttaatgacagacggattcattaaaaacagccggtcccttatccggcggccggcatcgattatgctttattataccccaaaacctgtgttctgtcattccccaattgccggggattcaggaaattcattacagctgtcacagtccagataactgaaacatgcccgcagtccgcacatctcttatgttccgtactgtgtcctgactgatttgtcaaaaaaattcctgataaatcctgcagtccggcgcaccgaattccactttgcctatacgttcaagaataccctgtatctctgatttatccagattttcaaatcttctgttatggattttcaacagataggtcttctctcccctcacgtccctgctgaaggtcagggtcagccccgaattggcatagccctcttccttcaaaatcttcctgacctgagccaggtagtcctcctcaaggcggctgtaatatccgtcctcctcacggaaggcatccctcgactgtcctttcaccgtacctgctatacaaaatgcggaaatcacgattaaaaccacggttactgctatcaaacccgctctgcttttaattctttctgccatagattcttcctccatcctgcgccccttttatcccttgcggcacctgttctgtccgatatcagttcttattatgtcgtactttttatatggtaatgatgtttgtttatagattagatgctccgaaaaggaaaaaagtttaaaattttttctaaattgcattaaaaaataatccaataagattttgtcattctttgctttaactataaaaagcatgtaaatgtttagctccctcacaattattgccaatatccatcctaattgccttcggcgatggattttagcactactgaaccgctttcttatgttacggccagcgcttcatgctggcctgcacagctaaatgcgttaacctgtttaacagttattcaagcgtaacatatacttctctaaaaaccttctaaaaataccctgttatatttcatttaaacagcctcctgtacaggcggtattttataaaaagatcaaaaaatacctctgacagaaatttttcccatcagaggtattttttgatttatttacagctgtccggcagcactacagttgccgttattttattaaacatcggttggagaaccatatctggcaggtatgaagccagccggatattacggccggacaagagcttctcccacaagcctgttgacaagggcgccgtccgcctttcccttgactcttggcataagctccttcataattttccctttgtccttcacagttggcgttacgattcccaggccggcaagaacctcatttatttctttccggatggcctcttcactcatttcctccggcgcaaattccctgagtaccgcaaggcgcttctcgcattcctctacaatatctgccctgtctgcgggagccagatcctttgtttcctgggtctgcttgatttccttcttaatgacctcattttcttccgcttccgtcaaatcctctcttttgtcaatggccttgttcttcagcgccgcaagaagcatggaaagcgtatccttcctctccttgtccttatttttcatggcagctaccatttccgctcttacttcatcaattttactcataattttctcccttctgcgcaccttggcgcccatgttatttaatccgtccagcttgggcggtgaaaaatctttttgcctttattgtcttttttaaccagcaaccgtcccgccgcccctacagcggctcccgcctctttcctataattcttccctgcaaaaataacaggtatacttctgtctgcttccctgcggcaccagattttccgcaccgcagtaggagcattttatcacccgcatgccctggggcacgctgtcaccctcatataatctttgtgcagaaggcagaccgccagtctcccatctggtccgcatttcctcctgccgcttatcctgcaggtgatccgcctcatccagaacagccttctggcgcaggtaatcagtcgttgacatattggcctgcttttctgttgccattgatgccggcggtgtttgatgagttcctttcactgcaccgtgcctgtgcttttccggaaccgtacctgcggaataatccggctgtggcgcgcggctctgcggcattgcattcccgttgttccgggtattctgcggcggtacggtagtgccgttcttgttatagggattccggtccttagtccccgaaccgttactttttcccttcaatacgccggatacagccgccatgattacaatccatatgattacagaaataataccgctcataccttttctcctttgctgttccgaagtgtgtctgaaaactgcctgccctgaaccataatggctgtctttacacaaacccgtccaggatccgaaaccttttaccaaaacgtgggcaacggattttcaatgcggattttcaatgcagttaacctgcattgctgtttttgtttactccggagctgtaccttacaatcagcagttcaacacccatcgtatcgttcagccgcccgctttttaccgcctcatcggtatccacgcacgcttccagcgcttcacgcagctcttcctttttaaaacgggaagcctggcttacgtatttacccgctataaagctgtgaagccctgtcttttccccgattttcctgttgtcatagccctttgccttcaattcctttacctggagcagcagattaaactgccttcctatcaggaacaggatacgcatcggcggttccttcagcgccagcagatcataatacagcttcaacgcctcccgctgcttcttcagcgcaatatcctcaaccatgtcaaaaatctggctggttacctgatgcgtgcataccgcttctatatctgcctcggtaatgctgtcttttttcagtgtataacagaagagcttctccatctccctgctgatattttccatgtcggaccctgttttctgcaggaaaaaatccaggcccgcaggagaaatcgttttattctccttcttaatcctgcccagaatccacctcttcagcgtagtctcatcctgtgtggcaaattccaccgcacagccgcagtccctgacagccttaaacagccggctgcgcttatcaacctccgactctatgaacaggatgcacacggacggagcaggctccttcatataatccgccagctgttcgccgccctttttaaaaaggccgctgtcctctatcagaatcacacgcctgtccgcaaagaagggcatggtttccgccaagtcaatcacttcgccggaattcacatcctttcctctgaaagcggtgaaattcatggtatcgccttcctgtacaagcgcttccttcagcctgtccctgtactggttcttcaggtaagcctcctgcccataaagcagatacgcctgtttgaactgtttcttctttatgtcttccaacagctgctgcattctcagtttcctttcctgcaacggttctggcagctgaactgttactttttcttcccttcattccttcgggttgtgaactgccggggtttacttttattatcatgacatattccgggccatcagtcaacgttcaaaaaagtctccaccgtaatttttttctgccttctgcgcaccgtaaccgcaccgcattcgtttgtgacaaaaaccgggatccgtgcggctttcaagcgctcaagaaccgctttatgcggatgtccgtagggattatttctgccgcaggaaataagggcgcaggccggtgctgcggcatccaggaattcccgggtggtcgaggtttcagaaccatgatgtgcggtctttaaaatatcgcagctttgcagaagtccgggggaagaggcaagaattttttgttctccctccgcatccacatctccggtgagcaggatggaaaaatccttatccccgttctccgcccgcagagtgagctgcacaaccagagaggctgtattccggtctgtaaagctgtcccttccatccggatgcagacacaggaattccgttttcccatcctttaaaagatccccggccgccatacggtacaccggaatgtgatagcttccggccatttccacaagccgggacggctcatcctgaacgacatgggcctgcggcagcaccaggccgccgatggaaacgccactcttttccgcccattcaaagactgcctccagaccattgatatgatccgcatcccaatggcttacgaataccgcctccagcctgcccacaccctgatatttcaaaaatgggatcacctgccaggttccggtatccttctgcgaagagctgcccgcatcatacagataatgcttaccgctctccgttctgatataaatacagtctccctgccccacatccagcatggtcatctgcatgccgtcctgaggttttaacacaaaaacaagacacagcagcactgctgcaggcacgcctgccggcctggggattttctccgccagaagcagaagaagcccaagacctgcagcaaagacaagaagctgccacagctccggctttcccgcatgccagataccaggcagaccttcggaaagcaggcacagcttttcataaaaaataaggattcctttcaccggaagcgccaggatacgaaggaaaacaaaaaacggctctcctatgcccccaacaacgcttccggccagtacaagaagcaccgttcctcccatgagaatccccatcagcgggattacaagcacattcagcaggatggacagaaggttccattcataaaacacagaaagcagcaccggcagggtggtaaggctgatgcagaagctggaacggaatccctgaagcagcctctgcatgacgggatgcttctgttgttccctatacatttttatataatttttctttcctttgtcttttccgaaaagctttacagcatcactgcccatccgttcaaaggcaggaatggtgactgctgccccggccgctgcagcaaaggacagctgaaaaccgccgtcctgaagccaggcagggttttcaagcaggagcagggccgccgctgtggaaagcgcggtgggcatatcataggtccttcccacaattttggcggtcatatagagtaaaaacataatgcccgccctggccgcggatgctgaaaacccggtcatgacaagataggaaaaaagtacgccgcaggaaaggaggccggacagctttcgtgataaaaagcggctcagcagacggtaaagccccatcccaagcagggatatgtgcaggcctgaaatcgccaggatatgggaaatcccggctccctgatataacgccttaatttccgaatccattccctttttttctcccagaagcatggccttcagtacagacgcttccttctgcgggaaaatattctccaacacctccccagcgcggcgccgcagacgatacagtgcatgacgccagccggaatagccctcgctcttccccgtcagcacagcctgggaaagctgcatgctgataccctgccctgcataatatgccctggcatcaaactcaccggggtttgtcactgttttaaaatggcgcgcctttccccgatagcaggccctgctgccgatctccggcaggcgcacttccccctcctgcagcctgcacatcacaccggtaccgccctgtgaccgcattggtattccctgttcctgagcggacttttccagtgtctgcgccggcagtccctgttcctgagcggacttttcccatacctgcatatctatttcctgcagcagctgcttctgcgcttctttttgcgccgtaatattctgttttaagtctctgtctgaaaaatttactgccctgataccggcagctgtgaaattgtttagatttgtattaaaagatatactgtcagtttttattaactcaacatctggatctttaaacttaagatccgattgcatttctgccccctgaaagggaagcgcatccgcagccttcagataaacgatatgtacaatctgcccgttttccgggtccatatagcttgtgatatccgaaaccgtcccggcaaccacagccgtctgcccgtcctccgccggaggggagggctggggcagcggctttatccatgtcattatccggactgcggccgtaaagcccagcattgccaggcataagggccgtctcattccacattttctcctgtctttacgagatccaggtttctttcataaagattggacagattgaaagtctccctgtatacgatgtctgtctttccatttacggctatctgcaccttgtttacattgggaagctccaccagggagttggcaatggaataaatcaccacatccgcagtaacattatataactgcgtcatgaagttttcatcaaaattcacgtaacagatgccgtccttgacggttacgctcaatattttcgtacccggattaatcaccggatatacgccgtcgatgtcaggaccctttaccagatattccaccaccagcttttccatggaaatattgctgttgtattccacaggcttgacgatttccaccaggccgtcccccgcttcattggcaaaaaagagcttgagcttcaccatttcataggaattgatttcttttcccgcattgtcaatgaacgcatcggcagtcatgggaccgattgccgtgcccgtgctgtctgccagcggctgtcctcccaccgtcatcagcacatgattgattccttccgcctgggaaagcgtcctcacaagcgccgccctcaccagaacctccgtggtgggcgcaagctttctgtagctttcatccacatccagatccagctgtccgccttcctccacccggaacccggtcacctggaagctgtttcccacggaagacttcagggacacatcctccggcaccgcttccatggcttccagcagtcctgctatctgtcctgactgctccccggaatcaatatagtgaacctctttggctatttttgtttcttccctgttgagataatagatatcaaaggccgttccttccggttccgccgcccccgtactgcaggccggaagcaccaggcagaaaagcagcagcatgctggctgcccatgccgattttttgtttgaagcatccttttttctgttcgaagtatccttcattcgatttttgaacctccgttcaggctttccgttcttccatacatgccaactgtacctcagatacagtcctgcgctgccttatcattttttcctgcacgataatcccctgtaaaaaggccgcagaaaaccacgtcatcttacataggtaagcgggatctttacggtaaagctggtgccttctccctccgtactggctaccttcaccgaaccgcggtgaagaaggatggcatttctggtaatggccagccccagtccggtgccgccgatttcccgggagtgggatttgtccactctgtagaaacgctcaaatatatgatcgtagtccgcctccggaataccgataccggaatcggagatctccacggtaaaaaactgatgatccgcatccagcagcaccttgacccagccatgctccttgttgtacttaatcgcattttccaccagattggtaaatacctgggtaatcttcacctcatcaatttccgcggtgaccggacgtatgctttcaaaggtcacctccacatcccgcagcctggcaatggggcggagacgctttaacaccgattctatcagttcattgatatccaccgccgtaatattcatctgggcggccgtcttgtccatttttacaagggagagaagatcgttgatgattttattttcgcgctcgatctcattggcaatgtcctgcatgaattcctgatacagctccagaggcgcgtcctcctgctgcatgagggaatcggccagaaccttcatggaggtaagcggcgtcttcagttcatgggaaacgttggaaacaaattcctgccgggaatcgtcaatcaccttcatctgcgtcagcagctggttaaaggcatcgataatgtgctccgtttcgatataatcgggaactgcaatgggctcgtccgtaaaaccgtcctttacctcggtaatcgcctgggtcacccggttgaagggcttgacaagaatggaggaaaatcccacggccacaccgaaaatacagatgatcatcacgatctctataatcagggccttccggttcaggatttccattgtcgtcgctatgctgtccgtggaaacactggcaagcataactccaactacctggctctgctccggcttcttccccgcatccgcctgcgttgtctgattctttccggagctgggggcttcgatgggaatggtcatttcgatataaccgttttccttgtcataccgggtggtgctctctcccttgaaacaccggatgacctcctcggaaataatcgttttgccttcactgatactgtatgtatcttttactatacggaaattgccgttaatgataataacgcggccgtcgtacagattggacatctgttccagctccgcgttaattgcctcatttgaggtatcctgcagataattattgttcagaagatggttggcaatgatcttgaactgcgtctgcgtatccgagatacgcaggttcaccgcacgttcttcatagctctgaaggataccaaccctcatgatgaagctgggaaggatgcccatcaccagcatcagaaagaatatatagaccttcatgctcctgagagcaggtattttcataaatagctttttaagcctggtaagcattttggcagcctctacttccattcagcctggcacattccccaaagccggaaatcaggctctgaagaagtagccgactccccactttgtatgcacatatctgggttcacttggattgctttcgatcttctcacgaagccttctgatatggacgtccaccgtgcggacatccccgggataatcgcttccccataccagcttcagaagattttcacggctgtagactttgttgggatttaagacaagcagctccagcacatcgaattccttggctgtcaggttgacctccttgccggcaatatagacgcgcctgctgtcgcagtccagcttcagatcaccgttcacaacggttttgggcgcgtttgacgcgttatcccttactgttgtcctgcgcattatggccttgatcctggccttgacctccagaatattaaacggctttgtaatataatcatcagcaccgtattccaggcccatgattttatccatatcatcatccttggctgtcagcatgacgatggggacattggaaaattcccgtatctgctggcatacctccagtcctgtcagcttgggaagcatgatatccagaaggatcatgtcaaattccgaatttctcgcctgctccagcgcttcctcaccgtcataggcgcaggtgacctccataccgtcctgctccaggctgaaacggatacctttcacaatcagtttctcatcgtctacaaccaaaacccgctttcccatagctcctccaaagattttattccgtaactgcctggtttcttcacagttactgccaaatcaatccgaaaccgcctgcggcggtggatttatgcactcctgaaccattttcccgcatgcagcgcagcaaatgctcctgccggccggacctttcccatctttactgtctgacgcatatcctgtccttcagctttgcaaagcttccctccttgataccgtccaccttcataatatcctcaatggattggaatttaccattctgctgcctgtaggcaacaatcgcatcagcccttgtctgaccgattcccggcagtgtcatcagctccgccgcatccgcggtgttgatatccacaaggccgccctttcctgttccattttcctccataaccccgcccggcgaaaaaattccctgttccgcttcttccagggtcggaatcacaatctgcatcccgtccgatatgggcgccgcctggttcacacctctttccgccgcgtcctccgcaaggccgcctgccgcctcaacggcatccacgacccggcttcccgccggcagcctgtacactcccggcacagcaactgcgccgcaaatatgtatcacacactccgcctcaccggacacatcctcaccgccggaaccgcccgccccgggaaacgcttccgcctcccccgctgcgccttctccggccgcatcttcctccccggcccccgccggaacctgttcctgcgaaagctcccgcagatccacatccctgccgcatccgccgaacatgaaagaaaagaccagtaccaaaacaagtactggagttattctgcaatttgacattttatctccttttcaacgtatcaccgctcccggcgcacccgaaaaggcccccgtaactcactgcccttccattgtaaaataaaaagaaaagttttacaagaggagagtggttttttttcacagctacaagccgggcaggcaggaacaacagccttgctgcgggggagcttgctcacccacagcaagactgttgttcctgcctatgcggcgccagccgcaaagtgagagagcgcagctctcgaaccccggcgcccgccccccaacccctaatcccttgcccttaatcctttgcccttaatcccttgcccttatcactcccacttaaacaccacaatccccgcaatagccaccgccatcccaatagccttccgccattcccatccggtcttctccacaccgaacatcccgaacagctcaatcagataagccaccagcagctgcgccaccacgatcagcataacggccctggccggccccagcatatccatactcttaatcaccgtataagtaatgaaagccccgatagcgccccccaaaagcatatacttgggctgcacctgaaacacgccgagaagagaactcctgtccgtaaacgcccatgcggccagacacacaagcaacgccgtgaactgcacaaagcagttggccgcccagatactggacgccttagtaacctgcgtgttaaaaaccccctgaatactcatcagcgcgccggaaatcaaagcaataaataaaccaatcatataggcctcctgtcaaaagggtcttttcaggctcccgcagcgctgcagcggtttccaaaccgctgcagcgccatcttgaagccccgcccttttctacattctgcccatacgattggcaacttattcaaaactattcgcagccgcacagtccctctgcagtaaccggcaatccttactcttcctcgccgatatagccttccgtctcctcaacaggctcctcgatatactcttcctcaaaaggctggcccgtcacctgcgtcataatcttttcagacagcgcttttaacgtatccgtcgcactttcccccgaccatacccgggtaaaagcaatttccatctgcacccagtaattactcgttgccatcatcttcggaatcggcaccgacagcgcatactccctgccaaacgcctccgcctgagggttttcaaagctcacgcccttcctggccggcatcctgcccgtacgctcatacagattctgcgcacgctccccggtcagataagcggcaaactcattggcaatgtcctttttctggctgtagccgtttaccaccaccgcattggtcacggaaagactgcgcgtcttcagctcctcatcgatattggggatattcgtcaccccatactcatacgggaactccccgttcttcttcgcttcctcgatcctgcccacaatatccgtggtagccaccgtaaaaaccagcttgccgtcaataaattcctgaattacagaatcgtaatccacctcatccggatcaatggaaaaaaactgattcaaatcctgatacgccatcaggcaccggatggcatccagattgtaaatatcaatactttccgtatcgtcaccgcaggaaccgcccacatcaatataattccccacaaagaagtaattataaaaaatatcgtccacatcccacttgaaaacagcctctacctgctccggcgcatcgtagctgtccgcaaaagaaaggatatcatcgattgtggacgggatcattgcattaatccgttcctccagctgcgcttcctcagggacaaacgtctccggctcaccggcttcaccttcgccctctgcgtccggtcccccttcagccgccccttccgtactgcctgcatccagcggctcaccgttttcattcagcgcctccatggcggcctcgccttccgccgcatccgcttcagcctccagagaagccgccgccagcgcttccatataagtcttattataaatcagcgcgcttgtctcataataaaagggataaccgaccagcctgtccttataggtcaccgcctccaacgccggccgggaaaaattctcttcgctcacaagccccgcctcatccttcacaggacttgccagccccgcaagataagccttttccagacagtcattgcttatgatatataaatccggataagaattggtctgcagggaatcctggttgatcgtctccagatattcaaggcccgataccagcttcggaatcacacggacatctttttcctctgaaaaatccagggcaacactgcccagataatcactcagggcttcgtccgtataccataaattcaccgtgggcttgctaagcagggcgttgtcgggtattttggcaagatcagccagcctgtcgcttgcgatcccataataaatcaatacaccggcggccgccgcgaccgctgccacggctgcaattcttttccaaagcttcatgcaaaatctccttttttcggggcgtttttaataccgtccggcagacaaacagaacaatagggctgccggaggctacgatatttttacttcatccaggcagtccctgaggattacgatcatgtcatccacattctcccgggtaatcacaagaggcggcacaaaacggataatattggttcccgcattgatcaggatcagccccttttcaagcgcacggctgataatatccccaacagggatggagaaaaccagcccctgcatcagtcccacgcctctgtgagcctcaataaaatcatagttatccaccagggcggccagtttttcttccagatatgcaccgacctgtcttacattatctattatattgtccttttcgaataaatcaagaactttactcacagccgcgcaggccagcggattccctccgtaagtggtgccatggtcaccgcttgtcagggaatgggctcccaccttttccgtcatcaggaatgcgcccaccggaacgccgcagcccagagcctttgccgtcgtcataatatccggcttcacgccgtaacgctgccaagcgtacatataacctgtacgccccattccgcactggatctcatccagaataagaaggatatccttttcatcacacagggcgcgcacctttttcaggaactcctcctgcgcaggataaataccgccttctccctgcacggtttccataatgatggcacaggttttatccgtcacctgtgaaaggacgctgtcaaaatcattcagctgcgcaaaacggatatttcctatcataggctcaaaggcttccctgtaatggggatttcccgtcacggaaagcgcgccgaaggtacggccgtggaaggaatgctccatggcaatgatctcatgatccgtgcgtccgtccttcagatatgcatatttcctggccgccttcaaagcgccttcaatggcctccgcgccgctgttggtaaagaaaaccctgtccatgccggaaacctttttcattttcacagccgcttccacagcgggcacattgtaataataattggaggtatggataattttatcaatctgtgccttcaatgcatcgttatactccctgttgttatagcccagggcaaaaacagcgatgccggcgcagaaatccagatattttttgccttccatatcatacaggtaaacgccgtcgcccttatccagaaccacctgataccggttgtaggtatgtaaaagagcggcttccgcctcgtcgatatattccttcatgctcaaagctttttcactcatgccattctctcctttttaccgcttcctacacttcctcatcatcggatataatcgccgttcccacgccttcgtttgtaaaaatttccagcaacaggcaatggggaacccttccgtccaggatatgcacccggttaacgccgttgcggatggctgaggtacagttgttcagcttgggcagcatgccgccgccgatgattcccccgttgattaattcctccgcctgtccggcagtcagccgggaaataaaagaggatttgtcattgatatccttatacagcccttcaatatcggtaaggaaaacaagcttatccgctcccaccgccttggcaatggcgcaggcggcatcatccgcattaatattgtaggtattgaaatcatcatccagcccaaccggggccacaatcgggagaaaatccttttccagaaggtcatagagcaccttgggatccacttccttgatatcacccacaaagccgatgtcctggccgtctgcatattttttatccaccttcagaaggccgccgtccttgccgctgatacctacggctttgacgccaagctcctccaccatggtcaccagattcttgtttacacggcccaggaccatttccgcgatttccatggtttcctcatccgtcacgcgcaggccgttcacaaacctggcttccttgcctaccttgcccacccatttgctgatggcctttccgccgccatgcacgataatcggcttgaagcccaccagctttaacagggtaacgtccttgatgacgttcctctgcagctcttcattgctcatggcgcttccgccgtattttaccacaataattttacggttgaatttctgaatataaggcagcgcttcaatcagcaccgatgccttctgcattacctgatccatttccttctgttccatcttcgttctcccatcacatgtttgcatccgtccttgtaaaattgccgcacggtgggccggatgctttcttcccctgcgtattcatacggtctgcgctgcaaaatgcgcaggcctgtatgaatgctttcattgcgcaatttatttttctcaggagcggtaatccgcattgatttttacataatcataggtgaggtcgcagccccaggcagttgcctgcgcttcgcccatcttcatatccacaacaacagtcaccacagggcaggaaaggattttagtggcctcctcctcgctgtaatccgtggcctggccgtccttatatatctgaatccgtcccgcgctgctttcaaagaaaagctcaatcgcctccggatcgaagctggctccgctgtagccaagcgcgcagagaatccttccccagttggcgtcgtggccgaaaatggccgccttggtcaggctggagcagatgacggatttggccagcgtcctggcgtcctctttatttgccgcatggatgacttttgtctcaaacagcgcggtagccccctctccgtcccctgccatcatttttgccagcgtttcgtttacctcgtgaagcgcctggcagaaatggaggtaatcctcgtttttctccgtgatctcaggatttccggcgcagccgtttgccagtaccaccagcgtatcgttggtggaggtatcgccgtctacggaaatcatgttgaaggtgtccaccacatccgcgcttaatgcctcctgcaaaagctctttggaaatggcgatatccgtggttacaaagcccagcatggtgcacatgttgggatgaatcatcccgctgcccttggacatgccgcctacggtcacggttttgccgccggcctcaaactgcacggccacctgcttggaaatggtatccgtggtcattatcgcttccgccgcctgggtcccggcttcctgcgtatccttaaggcagcctgccagagccgccacgcctgcggtgattttgtccatgggaagctgcatgccgataacgcctgtggatgctacaagcacacaatccccggggatttgcagcgcgcctgcggcggcatctgccgtttcctggcaataagcgtagccctgacgtcccgtacatgcattggcgattcccgaattcaccaccacggcctgaatatagggggaggtattaattttttcccgatcccataccaccggcgccgcttttaccacattgctggtaaaaacacccgccgccttacacggaacctggctgtataccatcgccatatccttcctgttcttatacttcacatttgcttccacgccggccgccataaacccctttgcagcggtcacgcctcctttgatatgttccatattctcctcctttgggcagggttgaaatccccgctgccgcttcagtcgttaaaacgctctatattttcagtgttaagtacaaaatcgtaatagttcagatcctcccgcttcgtccagccgatgcagcgccagaaggtatttcccacatcattcttggtaaaggcaatgagggataccttgctgatattctcctttttcagcgcattcatggcaaaaaccaccatggatttgccgattccccgcatccggtattccggatccacacaaacatggtacatacagccgcgtctgccgtcatgcccgcagagaattgctcccacgatttttgaatcctccaccgctaccacgctggtttccggatttctttgcagaaagcgctccacgccttctctggagtcgtcgatgctgcggatggaaaatcctttgattttatgccacagccggcttacctcgtcataatcatcaatgttcattgttcgtaccatgtttgtaattcctcacttctttatgtatttcggcagtctggcaaatgggactgccacatgccttggagagtatctgcaattttctccaggcctttttaaacgctgcgggatgtagcggatgtctgctttcaccgcgtactcacatatattcacgaatcacgctccaggcctgtatgagcttttccaacgtccatgccgcattggccgggcttgtggagggcagtctgataatttccctgccggcctgctccatacagtatttccggtaaagctggcacgccttatccccattggcaaacaccgcccggatggaggtctgcgccagaaggccgccgatgtcattggcctttacattgcggatggaactgtcgctggagccttcaatatcacaggtatctatcacatcccagatggcaatatggccgtcaaggagcattttcttcttttcttcaatggttacgggtacctctttcttaagaagcgccgccgtcaccctccagaaccggttctggggatggccgtagtaaaactgctgctgcctggatttcacggaaggaaaggttcccagtatcaggacacgggaatccctgttgaaaacaggctggaattcatgggttactcgttccataagctttttcctttactaaagaaattacagttcagcctgcatccactctgcagtctccaatattgctattggttcacaatgaaaaacatccgcataatcataaattctttcaatagcctccttaccaagggcatccgtaataaatttacgaggctgcagaaccttgcgtccgataaattcaatgagactgcatgtaaaaaacagtgcactgttatttttttctgccatggattttttcactcctttggaatgtgagggtatccagcgccaatatagtatggaaacttatctgatgtgttgggcgattaaattttgccagttcttacaactttaaaaaccttcaacagtttacgcctatccgtaccttctgtcaattccttcctggcaaccaccccacatccacaatcatttactgtttgttttcgctctctccccggtaaaccacctcaaattcctcgcagacgcaaatcatgtcttcggtaaattcaattccgcactcttccctgcactcccgggaaaatgcctctctgtgggcttttttccagtaggccagggatttatcgccttcgccctccctgcgcgcatattcttcggaaatatcacagaaacgcacctgcgttacctttgtgatccgggtgatgcaacggggccgctgtgcgctgtccaggatgacggaatagtctccggcgcatggaagcggctcctgctccagttcatagagcttaaggaggctggtggtggctcttttttctccggtcagcacaagcgtgcaaagctcatctgcgatttccggatatccgtagtaatacgcctcatattttttaatctccgggcaaaatccttttacgaaatccgcaatactgttctgatccatttatccctcccagcctcaggcttccggcattcggcgcttcaccaccctgccttagaattacaattatcttgcacttatacatctgccacaacaagctccatccggattcttccccatttttctttctgaaatgcaaagcattccggggttctctcatccgtgctccagcctgctataacggcggcatctcttttttgataaggccttaatctcatgctcgctcctccgccggccggtttccttacgggaacatgggaaccagctccagccccttggtttccggcagaccgaacatgagattcatattctgcaccgcctgtcctgccgcgcccttcaccaggttatccatagcgcccatcatgatgacgcgtccggttctttcatcgattttaaaattcacgtccacatagttgctgccctccacccatttggtttccgggcatacattcttatccagaacgcggacgaatttttccttgtcgtagtatttatcgtaagccgcccgtacctcttcataagaaggaaaggcccgggtgccgtccggctgcagcgtacttttcagggaagcataagccgttatcaggatgcccctgttcatgggaaccagatgaggtgtgaaatttatcagcatttcctctcctgcggccagggaaagctgctcctcgatctccggcgtatgtctgtggtttgccacgccataggccttgatattctcgttgacctcacagtaaaggttatccaccttggcgcccctgccggcccctgaagtaccgctcttggcatcaataatcacggtggacggatcgatcagtccttcctttaataaaggatagatggaaagagtggagcaggtgggataacagccgggatttgccaccaggcgcgcatttttcaccgcctccctgttgatctcacacagcccatagacggcttctcctatgtactggggagccttatgctcaatgccgtaccatttttcataggtcgccacatccttgatgcggaagtccgcgctcaaatccacaagctttgcattggaaagaatctcttcattaataagggacgcgcagaagccctggggtgtggcggtaaaaatcacatccgcctgctttgccagttcttccatattatcatccagacatacggcatccactatctggaacatgtttttatagacttcatagtacttcttgtcaatatagctgcgggagccgtaccatacgatttccacatcagggtgggccgtcagcagtcttaccagctctcctcccgcataacctgtcgctccaataattcctgcttttatcattttccttccattcctttcccttaaccgttcagttttcagttatctcacagatactgtcagaatccggctgatattttccggtaaaaccagtataatcagaatccgcccgaaactcaaccttttctgtcttttccatcccgcatagtcacgggggcatccccggttttcgcataattatacgtctgttttgcataatatgcaatagttttttaaagtttatgcatatttttcataaaaaacacttaaaaatatgcatattttttcacttgcattctaaaaagttttgttgtatattaattccagaacaaatgagccggcggccacaggccagggctcctgaaatttcacataattaataagcatgccggttttttgcggcaggaaagaggaacataatgaaagaaaaagtaatccttgcctactcaggcggacttgacaccacagcgattatcccgtggctgaaagaaaactttgactatgaagtcatctgcgtctgcatcgactgcggacaggcggaagagctggacggtcttgaagaaagagcaaaattctgcggcgcttccaagctttacgttttggatgttatcgacgaattctgtgatgaatacgttatgccctgcgtaaaagcacatgcggtttatgaaaacaaatatctgctgggcacctccatggcaaggcccctgatcgccaagaagctggtggaaatcgcccgtaaggaaggcgctaccgccatctgccacggcgctaccggaaaaggaaatgaccagatccgttttgaactgggtatcaaggcactcgctcccgacttaaagatcatcgcagcctggagaaatgagaagtggaccatggattcccgtgaatccgaaatcgaatactgcaaggcgcacggcattgaccttcccttctccgcagacagcagctacagccgtgaccgtaacctgtggcacatcagccatgaaggactggagctggaggatccggccaacgagcctaactatgagcatctgctcgtactgggaaccactcctgaaaaagcgcccgatgaacccgaatatgtaaccatgacctttgaaaaaggaacccccaccagcatcaacggtgaaaaaatgaaggtttccgatatcatccgcaagctgaacgagctgggcggcaagcacggcatcggcatcgtggatatcgtggaaaaccgtgtggtaggcatgaaatcccgcggcgtttacgagactcccggcggaaccatcctttatgaagctcatcagcagctggaagagctgatcctggatcgtgaaaccaccaccacgaagcttgatatgggcaataaattcgcacagatcgtgtatgaaggaaaatggtttacccctctgcgcgaggctgtccaggctttcattgaaagcacccaggaaaatgtaaccggcgaagtgaaattcaagctctacaagggaaatatcatcaaggcaggcaccacctccccttattccctgtacaacgaatccatcgcttcctttaccacaggtgacctgtacgaccatcatgacgcagaaggctttatcaatctgttcggcctttccagcaaggtacgcgccatgaagcagcaggaaatcgaaaaaaataaataagggatttcccatgaatgttattttaattctttttctttatgttataatagtgaatatagtgggttttgccatgatgggtatcgacaaacggaaggcaaaaagaggcgcgttccgtatcccggaggccaatctttttctcaccgccctggtgggcgggagcatcggctgtatcgccgggatgtataccttccgtcataaaaccaagcataaaagcttcgttttcggcatgcctgccatactgattgttcagctggcagtgatactttatcttttgtttgcggcaccagtacatttcacgcttatgtagcaaaagaaatccgcccgtctggcagaacagtcagacgggctttttgctgtgcggccgcaaaataaagcatcacagcggtgcaaaacgccgggcggacacgccataaatctgaacatacaaagaggaggaaaaagcaatgcatctagcggtatgtgatgacaatatagcggacaggaaacaaatggaaaggcttctggggcgggaatcggaccgcaggctgaataccaccggggttctttacgtggattccttcggcaaccgcagcgccattttgtcaactcccatgatctatgacggcctgtttatggatatggttgaggacggctgcaatgcggcggaaatcgcccgggagctgcgaaacgccgggaataccctccccatcattttctgctgctccaaaatcaattacagggaggaaacggacctgcctgacaactgcttttttatggacaagcctatccagcccgcagagctgaccgaagtcgtggagacccttctcaccatcaaaaacagccaggaaaagcggatggaattccgtacggatacggaagccttttatctgacggaggaagaaatcatgtacgcctatcccgatgaccgttatgtacgcattcatctggcaaacggcggaaacagggagtgtgttgccaacatgcttaatttcagcgccaccctgggcttcgatatcgactattccgcaaggggcaccaccaagcttgatctgggcttcatccgggtaagcgaatccggcctgctggccatgatcggctgcagcgccgtcatcaacttaaagtatgtggataaggtttccgccttccatctgaccatgacggacgggcacaaaattaaaattgcgccttccagtaaaaaggcgcttcgccagatggccgcggaaatgaaggaatgaagggaaagcggctgagtaaggctacagttctatttctttacagttaccatatcataatatgttttaccgatctaaaaacggctccgcctgctggcagtgccgtttttccttttttcatttaatttttaaacaactcttgcaactactgcaaaatccatcctaaaccgcctttggcgatggattttggcacttctgcagcatttccttacggtcaattcctgtgcgccgggaatactctttctgtcagactgcgatgataatcccgccgtcattggcatacatgctgctgattcctgcagtatcaaggattctggcttccgcgaacttggcctttgccagaatcatgtcacgcacgctctcggcctttgccagattgttgcagtgcgtaatcataaggcattttttctgcggattcgctgtttccctggccacaatatccgccatcttctgcagcgccttcttcaacccgatagcctgtcccagctgaatgatcgttccttcctccgtggctcccattacaggcttgatattaagtgtggaagccaccagggccttcacgccggtaaggcggccgttctttctgagcgtttccaggttgttcaggacaaaatacgtattcatttcatcccggaacgcttccagctgctgaacgatttcctcaaacgccaggcctttttcctccagttccattgccttcagtgcaatctgcgcctcgccgccggaagctgatttggaatccaccacatgaatttttttatcatggtgcttttcctcgtaaagattctttcccagcactgcgctgttatggcttccgctcaggttcgcagacagcgtgacaacgtagatgtgctccgcatcacagtcaaagctctgtttatatctatccggtgaagggcaggaggaacgggggcactcagggcactccgccactcttctcagaaattctgcctgattaaaggtctcatcatcctgtatccgccagtcccctacttcaatccccagaggcacaatctcaaaacggggatcttttttcagttcatccggcaattcacagcaactgtccactacaattttataactcattgattcctccgattattcactacaattacacgtagttttcattaccacttataataacacccgcctacatatattgtaaagagaatttccaaaagttatgtattttttcatcgcattttatgggggaatgtgatccggaaggctttgaaatttgctccgggggattttcccgccctgtcccagccgtccggggtgcgggggaggtgtctgttctgagcggtcagacgtaaaaattggatatttctaacagtatatttttccccttctgctgttaacgcggctgaactcctcacgcacgacttcgtctgtgcgttcgtcagacaagccgctaggggcaacagcagaaggggaaaaatatgctgtaagaaatatctcaattttttcgtgattccctttcagaacagacacctccaccgcaccccggacggctgggacagggcgggaaaatcccccggagcaaaacgtaaaggttctggaggacaatgcgcctcaaaatggataaaaagtggagggcgaaaggtggtttgctggatttttgaaggagatgggaatgaatttcattagaagaaagagagataagcgggtggtgaaaatggttgctgttggggggagttttcattataatagaggggaatggggccggcgtgggcgggctgaggacggaagcaggatggagagagattatgattgcattgcaggtgaaagaagttaagagttttatggggaagcttttggggtcgtcttgttttgattcttttttgttggaggaagccacgatttccacgtataatacgttccatattgacgggcatatgaaccgggattttttcagcagtgaggagtgggatgatcctgagttgcggcctgatgatttttctgcgtggaaaaatgtgcggccgttgtgttttgatttgattaaggggaagaaaacgccgtcagggtttaagtttattctgcatctgatgccccgttttattccggggatcctgaaggcgggggaaacggatattacggcggatcaggtgaaggctttggttctgacgtgtaagtatgacgggagcgggcttactttggtgacgggtaccgcttttcatacttttattatggataagagtgtggatgtcctgtgggacaggacagttaggacatttctgacgaaaaaggggatcggttttgatgaactctgatttgcggggctgcggatgcagggataaggaggggcgcggcgggaagccgagcggggaggttcccaggctgactttaaagggggaggaatgtggtttccagcatcagttcagtgtgcgggagacttatccgtttcatacgcatactttttatgagttctttcttattaataaggggaaggggattcacaggatcaatggttcctccgtgctgctttcggaggggtcttttgttttcgtgaggccttccgacaggcatgggtatgattttttaaatcagtatgatctggagctgattaatatttctttcctgccgtctatttttgaaaagatatgcgggcttcttggatgtgcgccgtctttttttacggattcccctttgtgtcttcagacggagctggctgagccggttttgtctgatatccggaaaaaaatgcttcatgtgggcggtttggagcctggtgcggcgcggcgtttgtatttgaatgccgtactgccttattttttgtatcatttttgtccgggaccggccctgcaggaggtggatccgctgccgggatggctttcttcgctgatacggcggatggaggagcctgaaaatttcattgaggggcttccccggctgatttccctggcgaatgtttcccaggagtatttgaaccgttctttccgcaggtatctgcatatgtcccctacggaattcattaatatgaggcggatggattttgcagcttccctgattctggaaaaccggatggaaattattgatatctgccaggagtgcgggttcaggaacctgagttatttttatcgggttttccagcggcagtatgggtgtgcgccgggagaattcctgcggaagaacaggccgggcaggggataggaaaggcagtaactgttaagggggaaacggagttactatacgaaggtaaaaaagtaacagggggccgcagctccctgttttctttataaaaaatattttggaaaaattttgcagttggttcccataatccggtaagtgaaacggacgggcgtttaacaggtgttaacggatattataaacgctgcgtattttcaggccgtccgggctgcctttcaggatttttacctttctttctccggcgtccatgtcgaagtagttgtcttcaaggagcatgtcatcggcttcgtttatgatttccacgcctcttgcataggcctgtgccctgacggtgagttcatcgccggaaacggtaaccgtaaggccgggatctgcgaagcggtagtgcttgggcgcgcagaagatgacggttccgccggaaacgcgttcttctccccggaagcaggtatagcttacataatcgccgtaggtgtcagcatccatacagtctgttttttcaagccagaggctggataacggggatacggttacttcttcgctgccggagcgcaggatttcggatcggttgtttctgagcgaccactccacgcgcagctgctgttcctgcatggtttcgtttgccacgcacagatggatggatttttttacctcgtaaggctctgcattggggttggtgtcctgggtgaggatgccttcctcggcgcaggaaagcatcaccggggcgaagaaacgcttcgcatagtagtgcagcgccttccatcttccgcagtagtcaatggaggaccagctggctaccggccagcagtcattgagctgccagatcacggttcccatgcatctgccgcggtttctgcggaagtgctccactccgtagcggatggcttccgcctggagaagctgggaggcataaagggtggtgtcaaaatcattggggtacaggaaagtctgttccatgtagttcatgattttcccatttgccgttttgttgcgctgatgtttttccataacataggaaaaaatattccggtcctccggctcggtaaaggtttccacagtttttaaggaggggaaggactggaagccgaattcggagacatagcggaagtagaatttccgatattccgtgattggcttgtttccatgccatacgtcccagtagtgtacatcaccccggttttcatcgttgggatcatcgaaagcgccgcctgaggaggggcttgcgggccagtaaaaggtattgggatcgtattccttgagcaccttgggaatgatgtattcgtacattttaacgtaatcgctcttctccttcggcctggatacccagttgccctgcgccacgaacatttccatttcattgttgccgcaccacagccccagggatgcatggtggcggatacgcttgatattgtcgatgaattccgcagtgatggtttcctcaaactcttccgtcagatcatagaccgcgcaggcgaacatgaagtcctcccacaccaccaggcccagctcgtcgcaggcatcccagaagctgtcataggggtaattcccgccgccccagacacggatgcagttgaaattggcatcctttgcctgcttcagcagcgagtaggttcgttccggagtcacccttgacaggatattatcctccggtatgtagtccgcgcccatggcaaaaatacgcacgccgttcacttcatgggcaaactgctcgccgtattcatccttttcccgatgcacgcccatcgtacgcaggccaatgcggccgctccagctatccagtacatttccatcctttaaaagctccgcttccaccagatacaggggctgctctccatagccgttgggccaccagaggcggggattttcaatcacggcttcttccgggcaggtttccgtaaggattaccctgccgtcaggatcggtcaccttcacacgccaggacaggccttccagctcttcctcatcccttccgaaacggcagatattttttcttcctgctttctgcacgtccacacgaagctgtaaggccacgcggcccggctcgtgcttctgggtaatgtaaacgccgtccagtctggcatggtcaaaggcaagcagcttcaccggacgccaaattcctgcatcaggaaggcggggaccccagtcccagccgaacatacagtgagctttccttaaatagggaaagccctgcatggcgtcggagctgccttccattggcctttccccgtaagcctccctgataaaacgggtcggggaatacagcaccaccttcagctcatttccgcagtcacgcagcaggcttttcaccgggaattcccagattcggtgcatattccggacactccccagcagcgttccgttcaggctgatatccgcgatggtatcaatcccgtcaaaatgcagtaaaacctcttccctctccctgatttcctccggcgcgtcaaaatatgtaacataggtaaaatcattatccatgattttaagagccttcagctcattgtccctgtaatagggatcctccatcctgccgttgtccagcagatcctggtaaacgcttcccggtacggcggcgggcagaaactcctccgtattgttgatgcacatctgccagttgtcatgcagcatttgtatccgcatcccaaatcctccttgtttttccgaaggaaaaatgcgagcctctgcgagcagaggattttcctccttgtttttacgaaggaaaaatgtgagcactctgcgagcagaggattttcctccttgtttttacgaaggaaaaatgtgagcactctgcgagcagaggattttcctccttgtttttacgaaggaaaaatgtgagcactctgcgagcagaggattttcctccgtattaaaaaaatctcgtatgtaatcaagttatcacttctgccctgtcttttcttcttttttgttgaccgattattgtactatattgacctgatatagctgccggttacaagccggcatcaataccccagattcctgtcaattaccgtgccatccatggcattgatggtaaaccagctgtcgtaggggccgcctgttacttccgttgttccgtcctctctttccacggtctggctgccgaagaaatcccacaccggcaccatggttccttccattacgttgcctttttccatcacgcgcatataacccaggcggatttcatctatggcaaagttcacctttatgttgttttccgtatagaatgcatattttttctggaacatttccttaaaaattttctggatttcatcaaagggcatcaagaatacgtattcatcggacttatcggtcaccgtatacggatcccaccactggaaatcaaccaggcccccatcattgtagatcatataaagcttttcataaggccaggacgaccagtttccttccgaggtactgccgtcggtatgggtataggttacaggaataccgtctatcactcttgtaaaataaacgccgtaaccgttatccgcagccaccatttttccctcttcatcctctgtaaaggttgaaaaatattctcctccgcaggacataaactcatcaaagcccatatctgcagctgcttgttccgctttactgatgatatcctccggtggtgcattcagggatgtgccggctgccggagcgtcacccaccggcatatagtttcctccattttccagataggaaaccatgaaactgatccagcgccaatcgggagtcagttcattgccaaggcttacaacataatcttttccgtccgcggtaacattgcccatcagccagtttttttcaggagtcccatttgccgcggcgtccggatcgtactgtacctttgcttcaatttcccttgtgcccaccgtctcaggcgcatacttcagcatttcctcaaagttttttattgcttccccgtagcttctttcgtccccgtattcatccacataggttgcgcccgtggcttccagcctcttcagctcctctatccgctgctcaatttccgcttttgtaaagccatgggccggatcgtcttcctccaccgcacgttcccacagtgccccgccacccagcagcacacggttaaccgcatcataatcctcctgggtaaaagtgcgggaagccacggttttcagccggaagccctccgccgcgggaaccgtgacggacgcgtccaccgataccgaaagctgccccgctgtatctgaaaactccagggcaaaacggctgggcgcctgcacctgctctgcgatactgccctctgccgcggcctgcggcgcctgtgtactttcctccttcggttttaccaaatcctcctgaggctccggggttcccccgcatccggcaaaaacggaggccgccaaacctgccgccatgattacagccatccaacgcttactttttctcatttcaattccctctttccgtatttgtgttactgttcactccgtgaccagtaactgtataaatccattaaaaattgcctgcggcaatgggatttatacactcttgaatcactttcttacgtactgtgcagtaaatgcacagtactgaatgaacagtaacgtatttgtttcatctctgcctgtttcagggcagccgccctgcgcatctgcgcgaaacgttatgcttcaggcataaaccaagcatacgcctgtgcctcgtaaaaagtatgcagcaggatgtaaacattttgcaaacagggttatattttcaaacatacgcaagccccggccggaccgttaccagtcgtttcagttccttcacagcttccgtcaggcttccccctggaaaaccaccgttacacgggttccttccccttccctgctttcgatatggagggacgcgttatgaagctccgctatcctgctgcaaagtgccagcccaaggccgatgcccccggcttttctgctgcgggatttatccaccatatagaacgcctctgtaacgcggggcaaatctccgggcggtattcccctgccctgatcggtgacgctaatttcatttccggcagcctccagtcgaatggcatcaccctcttttccggctttcacagcgttatctatcagattaataagaagactttcaaaaagatccctgtccagcctgcgcatctggccgtccgaccgggtttccaacgtcatcccgcactcctccaggtgatatttttccaaatccgccacccgggaaaacagatcctccacctccgtctcctccagcctgatactatcgttatcatacagaccgatcaggttcatcagcttgccggacagacgctccagcctcctgcactcatcatgaatacgatgcagcgcctgttcccgccgctcctcgctcagcttcacatgcagcagggtatcggaataaccgatgattgatgtcataggcgttttcaactcatgggtcaggcttccaagcagcatcccgcgctgcgccgaaaccttttccagctccgtcacctgctcctcaatccggtccgccatacggttaaaggaagccgccatggcgccgatttcatcctttgaaccagcctgcgcccgctgcccgagccttccctcgctgatatccgcagccgcctgctgcagcttgcgcagcggcttcagcagcctgcccgttatgagaaaaataatcagcaccgatatgactgccgccgcaaaataaatctccgcaaacagccaggcctgtttttccatatccgcataaagctccgtaatgtcctgcaccaggacaagccggtagtccgaaagggaatccgcgggcagttttttcccgagaatcagcagatgctgctcccccacctgccggaaatccgcggaagcctccgtccccgcccagcgcttctcccgcgggtttaccaaatcaaaagccgtgagattgcagacaacctccccgtccttaatcaatatgtattttgaagcgccgtatttttttaaaatataattataaaatgagcttctggttgcctccgtgtagccctcaagctcgctgtcgctgatttcctttcccagcgcataggcggtggcatgaagctgctgctcataattttccaccgtttttgtctcattatactgtacggtgcggtgaaccacaattccccctgtgacgccggtcgtcacaagcagtacggaggtggtcagaagagaaatttttttccaaagcttcatattcaatcctccagccggtagcctgttttgggaatggtccgtatgacctcaaaaaaatccagcttcttgcgcagccgcccgatatgcacatccacggttctggtttcccccatataatcgctgccccagacctgattcaagagctgctccctggaaaaagccacatttttattagccgccagaagcaccagcagctcatactccatcggcttgagggccaccggaattcccgccttcatgacctgatgctccttcctgtcaatcctcacgtcgcggatttcaatgatttccttccccctgcctgtccgttccagcaccttttccatacgcaccagcagctccagcacctcaaagggcttcacaatataatcctccgcccccgcccgcagcccgtgtaccttggaaatcacatccgccttggccgtaagatatatcaccggaattccggccgactgcatacaccccatcaattcaaacccatccttgcccggcaacataatatcaaccaacgccagcgcataagacaagcctccctctccgccgccggccaaacccgaaacgattttttccgcctccaccccatcataaaccggaaccggctcataccccgccgcctccagattcatacagataagctccgatatggaagcatcatcctcaatcactaaaattctcgtcttcatcctctttcccctcatccgcacaacaatcaaatcccccgctgcaaggaacagaatatttatcctttaaaaaattatgtactaaaaataccgcctgcccataatcccctttagtgtaacacaccatccccagaaaaaaagcaccaaaatgtaaacatactgcgcggcccggggaggaaccgccccgggccgccgcctgttgcggacgaagggcggttcttctccgggcatccactcccttccgagaggccgccttctcctgtcggaggttcacacccccattattttttcattttgggtttgaaaataagggaggcaatgtagccgaagataagcgcggcggcggtccctacggcgcccgccttgaagccgccggaaaacaggccgagaaagccctggctatctactccttccttgacccccttcatcagggtattgccaaagcccagtaagggaacgctggcgccggcgccggcaaattcctggaagggttcgtacaggcctatggcgctgagcacggcccctgtacatacaagaagaaccatgatacggccgggcatgagctttgttttttccatgagtatctggacgagggcgcagataaggcctcccacccagaatgcattaatataatccattttaataatcctcctactggttttgcggagcaaatgcgagtcctctgacgcgcgtgtacaaatcttttattcccgcgagcaacgagccaagtatccatgcttgcatggatatttggcgactgccgcgagggtcaaataccccttttcttgcagcggggtatttgattgcggaagcggggctttctgtgatttgcgttcaaatagttttttctacgctgtagtatgaggagttttgcgttaaaatattctttttggcaaaagaaaaagaagcagcgcgggaaattgattttagccgttctgcttcattcattgttaaattatttaacacaggcttcgtacaggctggaaaaccatccggcctgtacgaagcctgtgtaattttaatataaaattccgtcgtaatatttcaaaagaagggtaaccacgcggctgtagcttttcatgccgtcctccactccgttgattttcagcgtcgcttcagtgaactgattggaggctttttttacggttgcagtctggatcacggccttttcttccaccttttcccacgcttctgcagtgaggaacaggtcgtcgctgtaaacgcttttcgctatttccggatgttcaaagtacttggatgccttatggttaatggaatcacggaactcattttccacatagttaagtacgctcatgtagccgctgtactgaaagaagatgtcatcggagttaatacaggccagaaagccgataaaattggcttcgtcctcgtaaatgaagcccttcaaatgggcaagttcatggcagatagtggccggcttgttcacgatgtacatgcgtttattatagttggcttccattgaaaacgggaagtagtagcccatcatatgttcctggctgaggaaatcagaggaatggatggtcttggccctcggataatagccggacagctggtcgtactcctttccaagctcctgcatggcggtaatcgcgcctgcggtaatttcgtcattatatacaagatagccggtatcgtcccgttccatctcgacagtcagttcattcagcttttccacaatatgatctcttacaagggcaagctccttgtcagtataaccccgctctgttttttcgggcatatatttttcatcaatgggagaagcatggtaaagaagaaagcagttacacgtcataatccagaaaaccgcaagcagaatccaggcaaaagccgtatagaagcctttgcacacccgtttcagccattcccttctcacaaaaatcctaacagccgccagaagcaccgcttccagcagaagcagcagaccaaaggctatcatccactctcccacggaaaaaggaaagacggacatcagtctgccataggtattaatggacaccggaaatataaaccggatatgccagtcacaaaacgccgtacagttccatgccagaatattgattacaacgattgccgcaaacaatgcaaaccatattttcttcttcaaaaatctcatcccccgctcacctggcctgccggcaaatcaaatgtctttcccggcctgtcaggctgttttttcccctatttatactatacctgcggggcggtttcaaaacaagggaatcacagaaatgctagaaagagttaacagtctattaacaaatctgtaatggaaaatttacgtaaccaaatgacatcggggactgaacagttacaattttacggtaagaagaggataaaaacttgacaaaacagatcgtatatgttcctgcgtattgacaaaataaggggaattttatctttcaggaaatgggcataaaaaacggggcgaaaacggttcgccccataattatcatggtgttcattcttttatttttgaagacgatgaacggaatgtgcaaggattaattttacaaaccaccagagcacagttcatcacaattaaaaaactcataatttgcagtgagtttatcaatatcttctccccattctgcatagcctgccccaaagcagcaatactgccacatgggaattagaaccatagaagcaatctccctgcggtaatccttaaagcagcgttgccacgtataatcttttacgccatgcttcaacaggctgtcataataatgttttacaaggtcaatctgtatcctttccctgaattcatcgggaaaattaactcttgtcaggtgagctaaatcctttccaaataatccctgtctatctgtggatttgcagacatcatttttttatataccggatccccttgccaaaacatatttttcccccattcaccttatacggctgattgcatgttacctgttttatgaatcagccccggacataagcgccgcctccccggccttctccggcagctgcaccaggattaccgccgcaaaaacaagaacacatccgaatatttcctttagattcaacgtctcccccagaatcacccagccggccagcacagacaccacggattccaggcttaaaatcagcgaggccacggtaggatccaggtgcttctgcccgattatctgcagggtataggccacgccgcaggacataacacctgcataaagaacagggactgcgccgcttaccagcccgctccaggtcggttcttcaaatagaaaggcgccgattgtacagataatccccgccacaaaaaactggatgcaggagagcttcacgccatccgtctttggtgaaaaataatcaatcaccaggatatggatggaaaaaatcaccgcacagataaatacaagcacatctccccggttcaggctgagtgtctcattgacacaaagcagatacattcctgccgcggcaatcgccgccccggcccagacaattcttctcacttttttcccaaagaaaagtcccataatgggaacaatgataatgtaaagagtggtaataaatccggccttccccaccgtggtatactgtatgccgatctgctggaacatacttgccgtgcatatggcgagaccacagcagacgccgccaatcagcgtgatcttccgtctttgttttctctcctccgccgtttccttacgtgtctctgccttcttctgtttctgctcacggaatgcaatcagaggcagaagaaccgtgcctccaataaggcttcttgcaccattaaaggtaaacggccccatataatccatccctacgctctgcgccacaaaggccacaccccagatggatgccgcaagaaaaaggagcagactacttcggtagctgtgatctctgctgtgaccgatctgtccgcccctgctgctttcgccgttttgattcatttatatgtaccttctttcccgaaatttagtctttctgcttcagagcgcgcttgaaaaatcattcccgctcttcagtctgtgatatatctgaacattgtcataatccggcgcaaattcctctaccgcctgataaatcttcctgattgtttccacgctttcttccagctcctctgccgcttcctccggacttttcccttttacaagcttcctgcaggccagcttgataagcagaagaatttccccttcctgttttgccatttcttctatttcttccaaagccttacacatatccgtttcccctttcccgctgtctgcgtctgctttccaccatctgtccgcatgaagaagcgccttcagcatatcgtaagtatccggtggaatatgtctgaacacttcactgttttcctgtatatactccttcattcccgttccatcgccggccatcttcagcaatgaaaaaataagcttccagtccgtacggaaattatccggttccgcattttccggctgtattaaattgagccggtaatttgaaagatacgggcgcatgtcctcaaattcctccggaatatccatcatgtccagaagctccatcggcccatcccacggtgttgttccgtaataaaggcacagcgttaccaccggcacgagcctgtcctcagggaaaaagcctgataaaaactgagcgctgttctgatagtctccgttttcccgatgccttaatgccgcctgctccacctggctggtatagctcatggcatcgtagagcatttcccttacaggcatagcatagtgtgccttgtcctgcccttccacagcgaatatggcgtacaaggcatttccgcatgccttccggaccgcatccctgtatctcttaacagttaccttcctgccgtccttatccgcaaagctgacaatcgcttcccctggcaggctctccaggctgccggccttcagcacctgtttcccgccaaacagcgatccattgaacagatcacaaaaatgggccggattctccagaaatctttttactgccgaatctttttctttcttcatacaagtatacattctccttaaatcttgttggtaaatccaaaagatgtatactttatacaggttatattatagacatatcccgtcgaaaaagcaattccttcggataccaaatataaaaaatggaatcaatggctgatacagccggatgagtaaataagaattatgaaatatttataactgttcagtacccctcacagttacaattatttataccatatatctggagaatccgaaatagtaattattcacaaattgtaaaaagtgcagaagaaaaggcaaccattcagttttttcacagtaaccggaaaagtttacgcggcctcatgtgttttttaactgtataaaggattcctttgcagcataaaataacgttacaaaggaatcctcagaaatactgttaagtaaaaattcacagggcaaagtgagcggacaggtcggatacgatctggcggattctttttccttcgcagaaaaggatcacgtccgcatatttttcatataaaggaactctctctgcataaagctcctccagcgtctgcccgtccttcagagccacgccacgctgtttcaaatcgcccagccgtctgttgatttcctcacaggaaagctgcagatagactactgtgccgatctgttttaagtgttccatggcttcttttccatagattacactaccgccggtggcaattacgcagtgcttcgcctctatccggctgttcacatcattttccacctgaaggaagccgtccagcccttcttcggaaatgatttcatgcagcagacggccggtttcctcctggataaccaggtcggaatccaaaaaatgatagcccaggcatttggccagaacaacgccgaccgtgctcttgcctgcgccgggcattccaatcagtacaatgttatcttttgtattcatataaattatcccaggtacgcaattacttccacttcacagagaacgctcttgggaagctcttttaccgcaacacagcttcttgcgggcttttctgtaaaatatttctcatatacgctattgaatgcagcaaaatctgccatatcagccaggaaacagcttgtcttaaccacactgccgtaatttacgcctgcttcttccagaatggctccgatattcttcattacctgttctgcctgggcctcgatgccttccgcttcaatcgtaccgtttgccggattaatcggaatctggccggatgcaaacagaaaatctcctgctgctatcgcctgtgaataaggtcctattgccgcaggtgctttatcggtcgctattttctttaacataatattttcctccttttatttcagctgctgtcatgtgaatcaatttcacttttccaatcataccatcaaatttcgtgtcaggcaagaatcattgtggtcaaaaatcagctataattgaggtattcgtaaccctggaatacaaaagcttttgcacattttcttattcgtcaaaagctacggttacatagaagcccctctcattttcaatgacggctgttacgtctccttcctttgacaacagtttttcccggaagggatagttcccggacatggcaagggaagggtcaatggtataataatagttgctgggaaggactccttccgttaccgttacatggtcgccttcctttaacaggccgggccgttccattttaaattccattgtgcgcattgcttcatccttctttcctgaaactgcatttcctgtaatcaacgtttcctcttcggccgttatgttacagctaagcctgtagccgatccgtaactgcagccccccatgacaaaccgcctttattgaaggacggaagtttgggcttaatttattctgtgtctccccggtttcgcacgggagccggatacggctgaactgcaatgctattatactgccgccgcatgtgattggcaatgtctgttccgcgtgctttgatgctcagcctgccggtttctctgttatcccccaagcccaatctgccacttcctatacttccataacacaccgctgtcgaacaaaattctcccatgtcatatgtattatcgcataaaagtaaggtttccaagcacaccatcatacaataacatcggggcctgcagcaatcagcagcccccgatgcacatacacgtactcttataaaaactaatctataccggactttccagcactaccccatgggcgattcccggaacattctgtccctcattaaagcttgttttgctcagaagcgctcctgtaggcgcaaataatacacgcttccacacgccctcctccagcattttcaggacataggcggacagtgtcactgccgaacagccgcagcccgagcctccggcatgggtatcctgttctcccgcatcgaaaatttcaatgccgcagtccatatgctggccggaaatgtctattccttttttattcagcaggtcaattaatacggtctgtcccacttttcccagatcgcctgtaatgattttatcgtagtaatcaggctgcctgccgaaatccttcagatgctgctcaatggtatccgcagcggcaggcgccatacaggcccccatgttcatgctgtccttcagtccgtagtccacgattttccccggcgtaagaccggtgattttggccctggccttccctgttttctccgcgcccagcaaaaaagcgccgctacccgtcacggtccaggtcgccgaaagagggcgctggttaccgtaggcaagaggaaaacggaactctttttccgcactggcaaagtggctgctggtgacacatgccgccttatccgcaaagcctccgcttataatcatcgatgccagggtcagggaaaggccgcaggtggagcaggccccgtaaaggccgaacagaggaagttcatagttcaccaggccgaagctggtggcgatttcctgtcccagcagatcccctgcaaacaggtaacgtacctcctgcgccctccagcctgctttccgcagggcggtgcccagggcctccttctgcagggtgctctccgcatcttcccaggtctgggcgccgaacatgtcgtcctctcccaccaggtcaaataaatcgcccagcggcccttccccttcttttttccccactatggaggcgctgtctatcatgtataccggtttctgaaggctcacgctctgcttgcccagaatcggggaaaccggtgtttctttcctgtctttttccatttttaccgcattcctttctgtctggtctgcagttattatttggttattttaaggaaagtatgcaaacataagcccatggaaaaccagaattctttttttcataaattttacagacagggtaaaggaaaggaagccgccaaaaaacggcggcttcggattgtttttcctgcgttatattttcactgccccttaaacctgcaccagatgaatcagttttccctgaaaatcgccccacatcccggcgacctgaagacctgcatacatcagcgtatctccgccgaagacgccgtcttctccctcgatacgatactttttatccgggtgcagccctcttaagaatactctcctgctacgctggcccgtacggccttttacctggataaaagttacaaggctctccgttccgtccttggataccacctgccagctgtcatacatctgattttcagaagcggatgccagacggaaataatcgccctctctcaccaaatcattatacttatgatacatggcggtctgcgccggaatctgtttcctgtcctcctccggtatacgggtcacatccagttcatagccaaaggtgcctgccagcgccacatatcccctggtttcaaaaggcgtcacccgtcccaccgcatgattgggacagtcactgacatgcgcgccgatggtagacaacggataaatcaacgccgttccctcctgaatcgccagccgttcgatggcatccgtatcatccgagcaccaaatctgaggactgtaatacagcatgcccgcgtcataccgggcgcctccgcctgagcagttttcaagcaaaatattcgggaacctggaaaccaggcgctcctgcagtgaataaacgccaagcatataacggtgggacagctctccctgacgatccggcggcagcgccgcactccccagatcactcagcggccggttcatatcccatttcacatattcgatgttggcagagcttaacacccgttccatcatctcccatacaccgtccactacctcgctgcgggaaaaatcaagcacatattggttgcgcgcccttcccggggtcctgcccggcactgcaatcgcccagtcgggatgcttgcggtataaatcagagtccggagataccatttccggctcaaaccacaaaccgaatttcattcccagcctgttgatttcctccgccaggccggacaggccgccgggcagtttttcttcattcaccacccagtcgcccaaggcgcagttgtcactgctgcgggcgccgaaccagccgtcgtccagcacgagcatttcaattcccagtcctgccgcttcctttgcaatggcaagcagcttttccgtattaaaatcaaaataggttgcttcccagttgttaatcagaatggggcgttttttatctttgtatgggcttctgataatatgctgtcttataaaatcgtgatagtgcgccgtcattccggaaagccctgaggcagaataggtcagcagcgcttccggagcatcaaagtgcgcgcctgcttccagcttccagcaaaaatccacaggattaatgcccgcctgcagtctcacagaatcatactggttgacatccgcccggaattcataattccccgaataaaccaactgtacgccgtatacttcaccggtatcctgtgtggtattgggggtgaccaatgcaataaatggatgatcctggtggccggattccccccgtcctgatgcgacaccctgcatcccgattccaatcttctgcctctggatatgacgctctctggcccaggagccgtgcagggtaatcgcttcaaactcacgattatccatatccatgcacatggaggaaacctttgtcagccagattgtgttttcactgttatttagtatagacacatgccgcgcaattacatccgtgtcctcaaaaacagaatagctgagcactgcggtcaggttaagcacgctgtctgtgcaaagcagctccaacgtaaagcacccctccggcttaccgtcctttcccgtctttgcaaaggaagcaggcagtcccggaatttcttttttccctgtaaaaatttcatgcgagacatatgaaaggctgcaggctgtatggccggcctgcgtctttaccctgaaagcggcttcccgatagtcgcctgttccgtgtcccggatattccatcgggaaggaatccaggaaggataccctgtctcttgcattcaccgaaggcacatagggcgattcttctgttctgagcagatatgtcagattatgatcctccagtttttttccataataaatgtgcccaataaaatttccctcatctgttatcccgatcagataactggtatttttcgtatccagcttaaaaattctttctttttcaaaatatgtaattcccatacttttctccttgccttccttcattttaaatatcggatggatgcctcatttcctgccttgcctgccattttttacacctctcctccttccagcaccttcatctcaaacggctccatcctcatcggtattcccctgaaatcaaattcctttgctgcttcatcattattaaacagaaaggtgaagcgcttccccttgccttcgcgaaccgtcacttctacacgttccggcagattctccacgtagggaatatccgtctgacgcagcatctcttccgccagcctgcggcaaagcccgggcagccctaccgttccgatataataaacgcatcccttcccataggaatttttcgttaccgccgccttccctgcatagaagttctccccatagaccgccagggtttctgcgctttccgttctgattatatcacaccagcgcataccctggtaatactgaccatccattattaccggaattttacgattgccgacagcatcatattcttccacccagcagcctgtcatatctgaataaccggccggcagcggctgcataatacaattattatgctcatccttcactccgctgcgggccgtcagcagtacaatgccgccgttttgcgcaaatatgtgcagctggtctgacgccttttgggagcgcacatacatcgctggcgcaacaacaatgcggtatttccccaaatctgcctcctggtcaataatatccacattcactccgtaatgggtaaatgcactatgaaaagcctgcatctgttccagatagtaagcgccctccgcctgcagctgcaggctaaaagcatattcactttcaaatccgcacagcagcgccaccccggaccggatttcggttccttccatatgcttcagatttttcaccgtccggtacaattcttcaaattccgcatatcgcctgccaggcacattgctgtgatcgatcaggccatgccaaaacatctcggcgccgcctactgcgctgcggaaacggaaattaatgaccgcgtccgccccatgggcaaatgcctgcataccatagcctttgatcattcccggcttcaccgtaggcgccataggcatccagcaccccggcgtaccgctcagctgctccataatccaaaagtttttttgcttcacgccccggatgaaatccagatgaaaggcgtgagaataatatccctcttccggcagcaccgtcgcaggataattatcataagagcaaaaatccagcttgtcaaacagcttataaaaatccggcatatgatcacaaaaccaggtattggtggtaatcggagtctgcggaaaatactcccgcagcagccgctgctgaaaattcacataatctatcgtactgtccgacataaaccgctgataatccagcatataggccgggttatactgtgtcacagggcgatctcccaggggcggatgaacctgggaccatgcagaatagcttccgctccacacctcattatgatacgcctggttgacagcctccagggaaccatatttctctttcagccactcccgtaatttttccgcacagctgtcacagcagcaaaatccggcttccacttcattatctatctgccaggctgccagattggccatattctgatagtgctctcccatttttcggacaaacttctcaacgaatccgcggtacgccggcgcattatagcaccggtgcccccgtattgcgggttcctgccttttcccgtctcttcctgtctgcaggacttccggatatttttcatacagccaaagcggagggcaattggtgggcgtacacaaaataacctcaatattcctgtcttcaaataattttaccgcctcatccagccaggcaaaatcatagacgccttcctccggttccattttactccaggcaaactccgccatacgcaccagactgacaccgctttttttcattaaatccgcatcctgctcccacagggatttatcccaatgttccggataataatccacgcctgttttcatttgaagtcctccatctcaatattcttttaattatatctgttgctgtaaacatataaaccaggaacgcccggcggctgttcctgaaaatattttaaataactgcaaaatatgcttccttccaggtgacaagctatattatatcacttgtctgcccggaagggagcatatcatttagtacgcctgtgtacctccttatgtaatataaccatatccatagcgcctcgtttttcaggcaattacccgttaccctttcaggccggagaacgcaataccttcaatcagatatttttgcgcaacacagtaaatcagcaccatgggaagcagtgaacaaacggttcccgccataatcaaaccatattccgcgccatattccgtccggaaagcggccaggccaatctgtattgttttcagcttatccgtattcaggtaaatcatcgggcccatatagtcattccacatgaaattaaaggtaaaaacaaccagggtagccagtcccggcttacacatgggcattatgatctgagagtatattttcagctccccgcagccgtcgatccttgccgcctcggacagttccatcggaataccaagcatgaactgcctgagcaggaacactccaaaggcgctgaaaagattcatgaggataatggaccagtggctgtcataaaagcccatatttttgatgataatgaactgcgggatcatgatggcatgccagggaaccatcatcgttgcaagatagcacaggaaaatcttgtctctccccggataatccatctttgcaaaggaataagcggccagggagcaggttacgacctgtccgaccgtaacgattatggacagcttaatcgtattcagataataggtgaggaaatttacccttgtccacacctcctggtaattggaccagcggaagacctccggaatccatttgataggatattcaaaaatttccctgtcatatttaaaagaggatgacaatgtccagaaaaacgggaccagcatggtcagtccgattatcattaatatgacaaacagcagggaatgctgtatacgtacttttcttttatatgattttgtcagcatgctgaaagctccttccttttactgcatataggtaacccattttttctgtcccctgaactgaatcagtgtaatgatcaaaataataataaacaggaaataggccatagcagatgcataaccgaaattaaggtatttaaagccttcctggtaaatccggtaaaccagcacattggtcgcccggcccggtccgccctccgtcattatggaaatcagatcgaatacctggaaggagctgatcagcgccagtatcgtaaccataaacatggtaggtgaaagcatgggcagcgtgatgtggaaaaatcttttcagcccgtttgccccgtcaatttcagcggcctcatacagctgcttcggtatggactggagcccggcaagaatgataaccatgtagtagccggcctgtttccaaatggcaacgatcatgactgacaccagcgccgtactggaggaaaccagccactgaggcggattgctgatcccgatatggctgaggaaaagattcagcggccctctggtcggatgaaaaatcatggcccatacaataccgactgcaaccatggagctgatattcgggaagaaaaacatggtccggaacaatcctgtccccttgatccccacattcagcgccaccgcaaggagcagggcaataacgatggtacacggcaccgtaacgccggtataaaccaggttgtttataaaagaaacctgaaaatattcatcgctgaacatttttatataattgcttaatccgacaaaatcaaaggtcttaaagccatcataattggtaaaggaaattaccagtcccataataatgggaattcccataaaaattagaaaaccgataaaattcggcaggataaaaaggtagcccttcagccattcttttttaaattttttctttggcacagctgcattcttagccattttctcaccctttcctgaaaaaggggagcaattcccgcctcaacggttacccgctccccttttgtcacagtttatctcttacttgcccatcagatccgctctctgctgcaggaacttatccatagtttcctcaatgcttttttctcccagcaggtaaagctcggcattttccttgtagatattaagaatctggtcaaagttgctggatgccggagattcctggacctttttcgcattgaaaattacggatacggaatcctttcccacggcttccttataagctgcttccgcaccttcatccgtataagcatgtaccattccggtgctcgcataaatggcagcgccttccggtccgcacaggtatttcaggaaatcaaagctctcctccggatgtttggttgtagaggtgattcccgcaaactggaactgtccccaggtggtgcctggttccacgccgtccggaataggcatcggggcgatttcccagctgacatctgttttccctgcattaatatcgttgagaagcatattgatcatccattcaccctgaggcatcagcgctactctcttgttttcaaaatctgcaagatactgggtatccgtagccttcatttctccaaggctcatatgggatttgtccacattgtacagctggtttaaaagctccagggaatcctggactgcggtaacatcatccgcattcacatacacgccctgctgtgtggccatgaactgtgtatgccagtcaacccagtaaccgccccactgtttgtcagggccttcccctgcggtgagctttttggccatctctgcatattccgtccaggtaagctgctccggcatctcaacgcccgcttctgcaagcaggtcgggattataaaacagcatccagcaggtggtccttgtgggcagggcaaaaatctgtccatcgggataactggaatcccacatagcgccgtatttgctgatatccaactcactgtttttcaccatctccgtcaaatccatcaaagaaccggtatccctgtactgcgtcacctgcgcgagccccctgatatcaacgatgtccgcttcatctccggccgccatcataacctttaatttgtcatcatagctgtcatttgcaatactgatcatttccacatggacgctgtcgctctgtgcattgtattgctcaactaccttggaaatatagttttcttcatcactccagatatagaatttaaggtttgtcttttcaccgccctttgtatctgccgccgcagtatcctgcgccgctgtacctgtgccgctgtcaaccgtacctgcgctttctgtttttccaccgcagcccgcaagcagactgcatgtcattactgccgttactgccattgccaatacacgtttgaacttcatttcaattcctccctgatactatttatttgtcgtggaacttattgacacgacttagtatatatgtaaacatacccagtgcaaaggttgaaattttataaacctttgtgtatattatactaatagagtgatcgtacatttcgcattttgtacatatgcggggaggatttataatgttttatgcgctttttattcttcttttcatcatattttttatgctttaccaacatcacagggaacatcataccatttcctttacccttgttcttgtttcttacttctttgccattattgggatgatgatctatttctcccgtgacgcctattactacaatgtgataaagaactatttctatctgccggatcctttatggcgtaaattatttttcctgcccatctcccgttttaacgtcatacgtatcatgaatgttgcaagcctgagcattgtcctggccagcgtatattttgccctgagcttccacacgccctttactcccaggacaataaagctcacaaaaatcggaatctggatttatcttatgctgcagctgcttatttacgatccttcagttaacatccgtctctattatctgctatacccttcagttatgggatcgcagcagttctatgatgcggaaaaagttatttatctcatcacacgcagcggaaataacctgcttatgctcttcagcgtgattatcctgtttgtatcgttctatcattcaccgcggatacagctgatccgctataactttttactgatggcggtctgcttttttacgctcagcatcttttattttacttttatctcaagaacgccttcgttcctgctgcgcatttccaagcttgcggattcctattatttctggtatataaatctgggcagcaatgtaatattctacaatgtatttccttttgtgctcattattttcctgctgctgatatgctacagcctttataggctctcccacatcagccatcagattgatgtggaatcctttgaaatatccaaacagattgacgccacggaaaccacctccaaggtattctgccattacataaaaaacgaacttcttgccatacagtcggagctggagctgcttcccgccatggagtgtcccgaacaatccgtccaggaaaccatacaccgctgcgaaaagctttacagccggattgatgaaatccataaaagtacgaaaaccgacgagctgcatctgatagatattgatttgaaagaactgctggaacgcgtcctggaggcctttaaagaggaggcctgccatataaaaatctgctgcaactttcctgattaccctgtcatcgccctggcagatcccgtatacctggagcaggcaatccacaatatcgtcgggaacgccatcgacgccatgatggaaaaaagcagccgggacggcgaggctgacagccggcttctcaccctcaacctgcgctataccgacgactggatacacctggaaatacaggatacgggcacaggcatttcacagaataatattaaaaaaatatttactcccttcttttcctccaagtccacctccaggcactggggaatcggcctgtcgctcacctaccggatcatccaggcgcatgaagggaaaattgaggtgcacagcgtcctgggcaagggtacctcctttcagatactgcttcccaaaataacacagatatttaatgaaaaaaggagttttcatggaaaataagataagggtgctcatcgcagaagatctggagcctatccggaaaaaatatgtatattatctgtcccagtgcgctgatatcgaactggtaggcagcgcagaaagcggaaaagaagcggttgaaaccgccctgtcagccgttcccgatgtcattctgatggatatagaaatggaaacaaaggatgccgggatccgtgcttccagggaaatactcgcccattatcctgacattaaaatcatcatcctcaccgtgtatgaggatgatgaactgattttttcggccttccagctgggggtatgcgactatatgctgaagaactccaccaatgaggagattatatccggcataaaggcggcatacgaaggccgctctcccatccgtcccgaaatcgccggtaaaatccgaagtgaatttaaacgggtaaagacctatgaaaccagcttcctttacatgctgaaccttctctcctccctcaccgtaaccgaactggataccatgtatctgctttcctccggccatacaagggctgatatctgcgctatccggcatgtggagatgtccaccgtcaagtcacagatacacagcatccttcacaaattcaaaaagaagtccatcgcggaaatcataacctccacagaggatcttcacctgcttgaactggtcatcaaaaacaggcctgactaataatgtgtgtaacagttcaccctttggccgaactgttactgcatccgcccattaaaagtcgccttcggcgaggggcggatgcctgctgccgccacattttctcacggtttgcgcagtgaatgcgcaaacctgcctgcactgttacaaatgtgctgccgttcagcccgaatctactatacatccttcccgcttttattgtataatagtaaaagcgttcctccaaccggggcgcgttctaatgacagagggggattactcaaatgaaaaagaagttctttgccgatgaaaccggtttctaccgccagattttcaagctggttctgcctattgttatccagaatctgctgagcgccgccgtcagctcggcggatatcgtcatgctcaattatgtggggcagtcgtccatttccgccgtttccctggcctcccaatatgccaacatccttttcatggtgtattacgggcttggcacgggagccaccatgctgtgcgcccagtatttcggcaagggcgacatgcatgccattgaggtggtggaagggattgcgctgcgtttctccatcgtgatttcactggcgttcgcgtccgtggccctgctgattcccgaactgatgatgaaggtttttaccaacgatcaggagctgattgtgctgggagcctcctatctgcgttttatgagcatcacctacctgtgctggggtattacggaggtctatttgtccgtgcttcgcagcatcggccgggttactgtgagcatggcgctcaatattcttgccttttcccttaacatcctgctgaatgccgtatttattttcggtcttttcggcgcccccaaactcggcgttatgggtgttgccattgctactgcaacctcccgtattgtggagcttgcctgctgtttccttgtttcgtttttcagcaaggatattaagctcaatttcaggtttatgttcatccggaacaaacttttgttccaggactttgtaaagctttccctgccggcactgggaaatgatgtgagctggggcgtcgctttttccacctattccatcatcatcggccaccttggctccgatgcggtggcggccaattcctttgtaatcgtagtgcgtaacttcggcaccatcctctgcttcggaatcgccagcgcaggcggcattctgctgggaaaggtaatcggtgaaaaccgtctggaggccgcaaaggaggatgcgaaaaaactgatgaagctcaccattcttagcggcgcgctgggaggccttctgattctggctgtaacgcccttcgtgctcagatacgccacgctttcggaaacagccatgcattatctgaaatacatgcttctcatcaacacctactatgtcatgggcgccgccgtcaacaccactctcatcgccggcgttttccgggcgggcggcgacagccggttcggttttgtctgcgataccattgatatgtggtgctacgccgtcccgctgggctttattgcagcctttgtgttcaagcttcccgtcatgtgggtttacttcctgctatgtacggatgaattcgtcaaatggccatgggtcctgaagcattaccgcagtgaaaaatggctcaacaacatcaccagggacaacctgtttgaggaaaaggccctgcaatagccgggatccggtgccatcggattccatcagcaacagccctcacgttccgctttatatcgtcaaaaaaaaggacagcaaaccggcatacgcctgatttgctgtcctttccttattgattacatcacgcccatcagcttcaaaatccaatatatcactcccagcacccagctggtaaaaatcccgtacaggataaccgggccggctatcgtaaatatcttgcagcccacgccgaatacctggccctcgcttttaaattcaatggccggggccgccacggagttggcgaagccggtaatgggaacgagcgcgcccgcgcctccccattttacaatagagggatatatgttaaatccggtaagcaccacgctcatcagaatcaacagtaaggccgaccagccgccggaggcctctttgtccagccccattccggcgcaggtattcagaatcgcctgccctatcacgcagatgattcccccaaccacaaaggccttcagcatctgcagccatatattatgtgtaggagtcacctgcttgacgtactcctgatattcttttttttgcttttcatccatagccgacattcctttctgttatacaggaaactgtagttccttagaatctttgtcagtatatggagatgctgtaaaaattattcggaggcgtttgtttttcataatatccaatttgaataaaaaacggcccgtgcctctttttccccttcatataggcatccggtcacatggacggtgatgtcctctgccctctttccatcacaggataataaacacaggccagaggcgtatcctcctcttcccgcaaagactgcaccgcaattttctgcatacgatctccctccgttatctccaaccggatgcactggttgtatcctgtgcccttgtccgtaccagccatgtctgctcacaattatacggatgtgcctctgccggtataatcttccataaatccggtgattctaaagatatggaatgaacccgaatatgccgcttggacggcagaaccgcaggaggttaaacatgagcagaaaacgaaaaataatcggcggcatccttttgctgctgtttctctgcatagcaggcgttttcatttacctgaaagcagtcattcctccgggcgaagaatggctcgcatacaacagcggtaaaatcaccgcggacatcgaccgccagctggaggatctggatattgataccctgatatccgaaaaggaaagcctagttcttgaaaaaaacattgatgagcttcagcaggcagtgggccaggggaagctgacctatgaagagctggccgccatctgtctctaccgcattaaaacgcttgatcagagccggcatggctataattccgtaacggaggtcgctgcggatgttctggagcaggccagggcctgtgataccgcgcgaagcgctctcctccaatcaggcatacagttcccgccttctcctctgttcggtattcctgtattgcttaaagacaatatcaataccgcggatattcccacaagcgccggggccgaagccttttccaccttccttcccagggaggacgccgcccttgtccgcacgctgcgggaacagggcgctgtcatcttagggaaaaacaatctttcagaatttgccaattacctttcctccgtcatgccctcgggctacagcgggaaggccggccagaccgtcaatcccttcggccccctgaaaatctctccctccggctccagcagcggcagcgccgtatctgttaccgccaaccttgcccctgtctccttcgggacggaaacggcaggatccatttccgggcctgccgccgccaactccgtcgtaggcttcaagccctcccggggcagcatatccgccgaaggaatcatgccgttgattcaggcagttgacacccccggccctatcgccaaatgtgtcagcgatgcttccctcgcctacggcgccctttccggttcctatgccgatctttccggacaggaagacgccctgaacggtgcggtgatcggcctgcttacctatgattacaatcaggaagacatgataacccaactgaaaacggcgctggagcatgccggcgcacaggtaaaggagctccccggcattcaggatgtatccgtgcagaatatcatttatctgaccttccgacgggattttgaggcgtatgcgttaaaatacggtcttcccatcaccaccctgaaagagcttattgcttataatcaggaagattccaggcggcgcatccgttatggacaggatcttctggaagcagcggacggggtggaacagtgcgatgacggccccataaagggttccatacaggaagcgcagggaattctggatacacttttttcagagcacggcctggatgccgtcgtttttctgaacagcacggcctccgccattgtttccgccgccggttatcctcagttgacggtgccccttggcatggataaaaaaggagtcccccagggcgcgacctttgctgcggaatatggccgggagcgaaagcttctggagcttggctattcctttgaacaaaatgtgcaggggcggttccggccctgaacgaaggcttttttgccaggattttcccgaggcattagagccttgcagttcgccgcagccacaaaatccatttgatactcgtaacagttcagatagcagctctgttactcctgttgcaattattcagctgtccagccctttcacagttactttattttccctatatttatcaaaaaattttttggttgtttacttcgaacatcagttctgctataattaaattaaacggctgccctgcaatgctttctgccgcccttcttctttcttcccggcatgccagcagggtgcagcctgctcactcttacaggcggcgtactctgttaagccgggcctgtgcaggataatatccatatggactggaggtcctgggaatgtctgacagaatgtatttatgtattgatttgaaatctttttatgcttccgtagagtgtgtggaacgcggcctcgatcctcttaccaccaatctggttgttgcggatcctgaacgtcacagcggcactatatgtctggccgtatccccctccatgaaaagcatgggcgtcaggaaccgctgccgtgtattccagattcccgacaatatgaaatatatcatggcgccgccgcgcatgaagttatatatcgaacactccgccaatatttattccatttatttaaaatatgcggccaaagaggatattcacgtatattccattgatgaagcctttctggatatcacggattatctgcctatgtaccgccttacagccagggaactggcccttcgcatccttcaggacatccgtgacaccaccggccttcctgccgcctgcggcatcggtacgaacctgtatcttgccaaaatagccctggatatcacagcaaagcataattctgattttataggctatctggatgaagagacttaccgtaggactttatgggatcaccggccgcttaccgatttctggcggatcggccccggcattgccagccggctgtcgtccatgggaatcacctcaatgggcgaggttgcccatatggacgaaaagcttctttataaagccttcggcgttgatgcagaatatctcatcgaccattcctggggaagggaacccaccaccatcgcggaaatcaaagcctataaatcaaaaaacaattccctctctagcggccaggtgctgtttcgggaatataattatgaagaagggctgctcatcgtcaaggaaatggtggatctgctctgtcttgacctggtggataagggccttgtcacggattccatttttctttacgtgggttattcccgggataccgcaaaatcctcccacgggacctccccgctcaccgtaacgaccaactccgtacgtgtcattaccaaagctttttccctgctgtatgagaaaatagttaacaaaaccgcccctatccgccgcgtaaatatcggctttaacaatgtggtggatgaggcatacgagcagtacgatctctttaccgacccggccgagctggaaaaagatcggaaaatacagatggccgtcctggacatcaagaaaaaattcggcaaaaatgccatcatgaaaggaatgaacctggaggatgccgcaactaccagagaacggaatcttcagataggaggtcataaaagtggcgaatcagactaaggccgaccgtgctaaaattttcatgccctttgatgcagtaaaaggcttccgtgaagctcttgctgaaaaagagcggatcattgttcccaaaacagaactgtcagaggagcgcaaggaagagctggaccgcaggctgaggatgatacacaccggagatatcatcaccgtcgtttactttcatgacggtgaatacgtaaagctcaccggcatggtctcaaaattcaatcccgccggcagaacgctatccattgttaataccatgataccccttgacgatatccgcgaactggagaattctgcagaagataatttctagggcaaacgaatataaaccagccggggcacaaacctgctttaataaatgggcgggaaatctcatcacagctatgccctgcgcgccctccctgtcccaccgcaacaaacgctgcaggcctttttgcagcctgcagcgtctgactattatacatatttaaaattcccgtttcgtttttacggtttctttctcaatcttttcttactttttcccatgctccgcatcccagtcttcatttgctttttccaccttcagggaatacagaagtattatcataattatgaccatgataaacgggaaccacagatacaggaagttcagcatattaatacaggactgcggctgaatctccgcgtttgctatataaccgccggctgcgagcagccatccggttaatgcggtaccgatgccgcttccgatcttaattcccagtgaggaacaggagtacatggttccgtcaatcctcttgccttttgtcctgtaggtataatcgctggttgctgcaatcagcgcgttcagatctccggtcagggggctgacacagagtccggcaagaacggagaagcacagcatcatgggaatattgcccatcattccgcccacaataaaaccgattctcataaagaaagcgatacaatacccgaacagatttaccttatacattccctttgcttttttcaccagccagggagtaaatgccaggccgataatcatcgggaacatctgcgccgcggaaaaggttcccagcaaagcgggattgcccagcacataggtcatataataaataccgatgcccgcaatgccagtctgaatataagtcaggacataaacagctacaataatcagataatatttgttcgcaaacagaagcttggcggattcccaaagggacagcttatcttcccctcccttttcagcggaggtctgcaccttttcttcttcatccggcacttcctttacagacaggacggatatggtatttaccaccagtccgataagcccgtacacaattgccacgttacgccagcctgcagcgccgccgcccatggatgccactgccttaatggtaatggatgccactaccaggttggttgccagggaaaacatgaaccggatggagcccatctgcacacgttcattgttgtttttggtgataagcgctgttaaagatgcatatgcaatattgtttgcggtatagaatacagcattcagcagcgtgtatgcgataaagaaataagcatattttgcggtatcaccccaactggagggaatcgcaaagatcgcaatcagacatactgtatttcctatgtaggaccagagcatccagggacgcgctttccccattttactcctggtcttgtcaatcaggctgccgaaaaatacgtccgtcacaccgtctgcaaattttgagaacatcatcagagttcctacaatacctgcattcagccccaccgtatccgtcagatagatcagaacaaagcttgtcaacagggcatagaccatattggctgcccagtcaccggaaccataccccagtttgttgtaccatttcaaatactttttttcctgcatatccccttgcactccttttctgtttgtccaaaccctgcatctgcgttgtatgcccggtatccgtgtctccggatcttacatccccgccattacagaagtccggcatttttccccttttgcagttgattttctctctgcaattagtggtgtgtacgagcaccatatttatattttagttttacacttccattttgtcaatagagcaaagttatacgtaaatatttctatgcatttttcacaaataccaagttgtaattttattatttttttcgtacaaaacgtaaacatgatgtgtccgcacacattttcactctgtattttacatattcaccacatttctgcaaatgcagtgctgttttacagtactacaattattgcgtaaaaaaagcaaacaaacttaaagtgaatacagatctgtgctgttatattctatgataatctgatatactcaggaaaatggggattgaaataatggacatatgaataaagaattgtaaaattgaaaaggggaattttattctgattgccgccgctatggctgttattatcgccgcatccgctgccaaatccgttttcaccgttatatccgcttccgctgccaaatctgttttcgcgctgttttgccctgtttttgcgtccgttttccttcccggcagtcgtaatcctgccggcggcttctattttaatattttcacggcatcagatatcagggaggttataaagatatggacaagctgctgattattgacggttccaaccttctttttcaaatgtttttcggcatgccttcgcgtattataaacgggaagggaaaggcgatccagggtactctcggctttgtcggcgccactattaaaattatccggatgacctgccccacccatgttgtaatactctttgacggagaacatccaaatgtccgtacaattctgcttcccggttataaagcgaaccgcccggattactcgcaggtggatgaggcggataatccctattcacagcttgcggatgtatacgccgcgctgtcgtttatgaatatcaaatatacggaggtccaggaactggaaaccgatgacataatcgcgggctatgcttacgcctatggggaacaaatgtcagtggtaattgcttcctttgacagtgatttttttcagctgatcaatgaaaatataaaggttttacgctaccgcggcaaaaatacggttgtctgtgatcctgattatatcaaagaaaaactgggcatcgcaccttccctgtatgcggattttaaatcccttacaggtgacagctccgacaacataaaaggcgcggataagatcggtccgaaaaccgctgcccggcttctccatgaattcggggatttggaaagcatccttgaaaattccgacagtatcgaaagaccgtccataaaagaatcaattgtaaaaaatgcagaacgactgcgcacgaattataaactcataaagcttggcggcaaagctgtaatcccattttccataagcgaattagaatataattacagcggaattacaacaaatgaagtcctgaacggaattggattaaaataaatgcagaggactatctttcaggcgctttatcctcaagttttctgttcagttcctccagtaaagcaggaagctccgaaggatgatgtaccgtataatccggcctccagtcctcttcctctatagttctgtaataacgcggcgaccagtccagccagatgctggtaatcccaaaacggtttgcccctgcaatatcctttttcagattattgccaatcatgacaatccgtttcttatccttttcctccagtcccagctgttccatggctgtctgaaacataattgcctccggcttctgctgtcccaccgtttccgaaactacccaggcatcgaagcagctgcgcagtccgttttttctgtaaacattctgaaaggacgcttcttccccgtccgctacaagcgcaacagtgtaaccttcctcatgcagctgctgcagtatttcccctgcattttcaataaactccgcctggcttacaatccccggttcctgtgcatcataaacctgggaagcctcgttaataatggtgtctccgctatccgtaaagataatcagcgttttatttttttccatcatactttctctccttactctgcctgtaaaaaactttgttttttttacaaatttcctctgttttgactttttcctgtttactgtacaggaaaacaatttccggtctaagtatacctgcaaagcccaaaataatctatgtaatatttgtcctggaaaaatcaaaaacattgcattttttgttttattttttcttcaacaataccgtcccctgctcatgactttcaatttccaaaaagtcccccgaattctatcagtagtagaaaaacggctgtaaactcaaaaaagcagttattgtaacagaccatacgcacaggctataatcactgtataagaaacggaggaatgagcaatgctggacagtattaaaatcggacattttatctcagaaaagagaaaagaattgaaaatgacgcagcaacagctggcggataaactgaaggtctcctttcaggcagtttccaaatgggaaaacggaagcgcttaccccaatctggaggttctttatgagctggccgtggcgctgggtgttaaggtagatgatattctcaccggctgtgaaaaaaccggggaaggtctttcctacagcaaggctggcattgacatcacttacacggacacaattaaacaggaaatggcaaagcatctggaaacaaaggacaggcgcgtacttaatggcctgggtcccttcgcctctctgtacgacctgcattttcctgaaatcaaagaaccggtgctcgtgctgaaatccgaggagccgggttctaaacagaagctggcaatggaatacggttttacggaatcaatctgccacgacatgatcaatcatctggtgaacgatattgtggtcatgggtgccaggccgctggccgttctggacaccatcgtctgcggaaatgcagaaaaggataccatcaaaacactggtaaaaggaatttcccaggcctgcagggacaacgaatgctctcttgtgggaggtgagacctccatacagcctctggtcatcgatgcaggtgtctacgtactgacctccagcattgccgggatcgtagaaaaaagccacatcatcgacggttccgccattaatgaaggggataccgtgcttgctgtggcttccaatggtctgcataccaacggctattctcttgtcaggctccttatggaaaaaatgcctcagataaaactggatcggatagacggcctgacatttatcgaacagattatgaagccccacacgccctattacaaagcggttaaagaactgttcggccaggaatatctccacggcatggctcatatcacagggggcgggatagaaggcaacctctgccgcattatccctgatggccttacagcggaaatcagcctgccgcaaatcaggtcgcttcctgtattcaaatatattaagctgcaggggaacgtggaggatgaagaaatgctgcggaccttcaactgtggcgtcggctttgtcctggtggtttcccaggaaggaaaagaggatgcagtacgccgcatctcccaacattacccctgctatgaaatcggaaggataacaaaaggggacaggaaaattgcaatgaaaggaagactcagctggctttaatcagttaaaaaagcataacacctctttcccctgaaaaagaggaagaaaccggtacagactgctgtgcccattttcttcctcctcatcaagacgtcctctttattttccaataacatgcaggaaggttccccgcagctctgttctccgaataagcaggcagcgctatacattctggctgatacgtatgcttagctccgtaaaatagtattccttcgtcggttccatgccaagcgccaggaaattgaagagaagctccaacggaagtgctccctgtttttccggttcctggcatatggtagcggcaattacgccgtcctttaccatctgacgctgcttttccaccagatcgttggagatgatcttaatgtccctgccggtgctggctttgcgtattgcctgacagatgctgtaatctccgggatttaccagatatagaatattgatttccggatggcgttccaccattccctgcactgctacaaaaaaatcaaactgatccttctcccttgtcatcacctgctgggaaaccacggacatttccgggtatctttcactgatttccatatggaagccttccatacgcgccttaaagctgcttatggtaccgtcatccacagaaaccacacctacccgggctttaccatcggtcatcagggccgctacccctgctgccagccggcccgacttctcgtagtcacagccgacataggccatcctgtccgctcccggttcgtccatattataaaaaattacaggtaccggctctctcccacatgacttcatagccctggtaaagtgctcggacagaacgccgttaatcacccagccgtccattgcattctcactgacaatacgctccaggcactcttcacccatcaactcctctatcctggtaataaaaaaaagtacctcaacgccgtactgcttcagttcctccgcctgcttttccgcgcctttgagcacatctgtaaaaaaaggcgcaaattcatcgtccacacagacaaaacccagcttcagatgcttcttcctcgccgccaggccttttcccgccacattcggcttatatcccagttcctgggctatccggcgcaccctttcctctttttccggattcacctttccccggttattcagcacacggtccaccgttcctcttgaaacaccggccctgtccgcaatttcttttattgttaccatacctgtcaccttttcctgttttcatctggtaaatggtctgcattgttatttttccgcatatgccggactttaacgtaaattgtagcatcccggcaggccggtgtcaaattctgtgccaaacgaaaaatcaagcaaaacagcttccggaaaaggcttcagccattcccttcctgtctgcaccttcgatactccaaaaactccatttcaaagattcccatgccaccggtcatgctctttagttccacctggaattcctttgccgtatcaaagggcacctggcctgaaacctccagttcatcgccgttatagcccacatcgtcaatagaagcctgcatattggcaagcctgcccatcagtctcttctcacagcctgacggtgcaaacagccggtagctcataaccggctccagcttaatcactccggcctgctgcagcgcttttctgaccaccaggggcgcaagcctgcggtaatccgcaggtgtactcgtcacactgtcgtagtctgcgtccacgaatacaatccgggtatccgccacggcatattcaagcccttcctccagtgccttccataccccctctcttaccgcattctgaaatgatttctctataaagccaaaggaaacctgcgtctcataccggttgccttccccagcctccagcggttccatccgtattccgattcccgctctgtgcaggttccttttttctcccattcgtatttccgcacaggcagctgaaacaggcttttccctgcatatcgtcttcatcccggaaaattccgctttcacaccaaacctttccgccagcgtatcccggaggatttctatctgcagctttccgaacaaatccatcagtatttcccctgtctgctccgataccctgaccttaagcaacggatcctcctccgtcagcacattcagcgcatccagaagccggtatctgtccccagcctccgccggcgccacatttacgcacagcatcggctccatcaggcgccccatatttttaccgccgcaggcttcaccgataaatccgctgcaggacagagccggaatatccgtcaggattccgatgtcatttacccccacctttacggcaggtatcagcctgccccggcttacagtcatcagattgttaatcgtgatctcctgatccgccccggcagcggacaccctgtccttttgcgaaatcgttccggaaaatacccggaaaaaaaccttcttatgtccgcactcatcatgctccaccttataaatataggcggaaagacggctgttttccggttttcttacaggaagccagcggactatcccccgcatcagctgttccattcccagatccttcagggcagaacctgcatagaccggatactgccgcccttttcccacgcggaaccttaaacatgcctccagctcttccgcctccaccttctggccatccaggtacttttccagaagcttttcggaacacatgataatctgctccgtgtaaacggtgtccgcccagtcatattcccttattgtataatcctgctgcggcgtccgcttaacctcctgcatctgtataatcctcgttgacagctgggttcggatctgcgccagaactgcctcatagtccgcgcccaccctgtctgttttgttaatgaaaaggatgaccggcatcttcattttcttcagctggtgaaagaggattcttgtctgcggctgcacgccctctcttgccgatatgaccagcaccacgccgtccagcgcccggagggaacgctccacctccccgataaaatccacatgacccggtgtatcaatcagattgattttcacatcgcctatgggaaaagagacggtggaagccttgattgtcattcccctcttctgctccagctccagggaatccgtgattgtggtccccctgtccacgcttcccctgctcttaataattccgctgtgataaaggagactctccgtcagcgtggtttttcctgcgtccacatgggcgagtatgcccaggttcaatattctgttttccattttccatacgctttccagccagttttacattccttatatggggacggaatgcctgcctgcggtaaaaaagcgtacaaaaaaaccacagtctgtaactgtggttaaaataatcctgttaaaaagacgtttcttatctcaacacatggcaggctgacttattatttatgaaattcccatggaaaaaagtttttctcatatttaatcaacctcctgccgtttattttgttcagtatagcaagccggacaggacttgtcaatgctgatttcgttttcatgctgatttcgttttcatctttcctgcagaatttgttttcatctttccttatacggccttaccagcagatagaggaagcctgcaagaagaagtaccgccactacggtgccgatgccaaaggcgcctgccgtaaagaggataccgagctggtatacacagagggaaaccacatatgccagacccgtctggtagccgattgcgaaccagaaccattttgcattgttcatttctctcctgatagcacccattgccgcaaagcagggcgcgcacagaaggttgaataccaggaaggagtatgccgctaatgcggtcatgctgcctgccagcgttccccagatttcggtgccgtcttcggcaacctcggcaaaaccgtaaagaataccaaatgtacccaccacgttttccttggctaccagcccggtaatagccgccactgtggacttccagtctccccagccaagcggaatgaaaatccaggaaacggcgccgccgattttagccaggatgctgtggttaatttccatagcttcaagcatcctgaactgtccgtccacccatccgaagtaagtggtaaaccatattacgatagtggaaagcaggataacggtaccggcttttttgatgaaggaccagccgcgctcccacatgctgcgaagcacatttcccacggtaggccaatgatatgcaggaagctccataacgaagggcgcaggatcccctgtgaacaattttgtcttttttaaaataatgccggagcagatgattgccccgattcccacaaagtaggcgctgggtgcaacccaccaggccccgccgaacaacgcgcctgcaatcagggcgataatgggaagcttcgctccgcagggaacaaaggtggtcgtcataatggtcattttacggtcacggtcgttttcaatggtacgggaagccatgatgccgggcacgccgcagccgcttccaatgagcatcgggataaaagattttccggaaaggccgaatttgcggaaaattctgtccatgatgaaggcaatccttgccatataaccgcagctttccaggaaggccaggaaaataaagagcaccagcatctgagggacaaagccgagcacagcgcccacgccggccacaatgccgtcaaggataagcccctgcagccagtccgcacagcctgccgcattcagcagggattccacaagaacagggatgcccggcacctccaggccgaacagcctccagccgtcaccgaatacgccgtcgttggcccagtccgtggcccaggtgcctacagtcgttacggaaacataataaacgataaacataaccactgcaaaaatgggaagcgccagccagcggttggttacaatcctgtcgattttatcggaggctgtcatgtcctgcttcctgttcctgctgtagcattcactgataatggaggaaatatatacatatctttcattggtgataatactttccgtatcatcatccaattctttttcaatccggtttatttcttcagatacatcagggacctgcgccatctgctcctgaatcttgtcgtccttttccagcagtttgatggcaaaaaatcttttctgcgcttccgggacactgctgcccagctttgcttctacggaatccagcacgctttccacttcgggggcaaaggtatgtacaggcactgccgcgtccttacggcctgcgatgctgatggccttttccgccgctttccggataccggttccctttaatgcggaaatctccacaacctcgcagccaagctttttgctcagcctgtcaaaatggatgacatcgccgttcttttccactatgtccatcatattgacagccataaccaccggaatccccagttccatcagctgtgtggaaaggtacaggtttctctcaatattcgtgccgtccacgatatttataatcgcatccggcctttcgttgatcagataatttcttgcaacgacctcctccagagtatagggagaaagggaatagatgcccggtaggtccatgatgatcacatccatggaacctgcggttccgtgtgaccgcttcagcttcccctcttttttctccaccgttacaccgggccagtttcccacaaactgattggaacctgtcagcgcattaaacaatgtcgtctttccgcagttcggatttcctgctaatgcaatcttaattgacatattctacctctttccgcctcattgcagctatgtttcctgtcatttgatttgtctaaactatcttttattagttatatctaactactgtccaaaaaaattttattccaccaaaatcatttccgcatcggctttccgcagcgacagctcataaccccttacagttacttccacaggatctcccaggggcgctgtctttctgacaaaaatatcaatccccttcgtaatccccatatccataatccttcttttcactgcgccttccccggtaagctttgtcacctttacgctttccccgcagggaatctcttttaatgtcctcatcttgtctccctttcttctaacataccatgattttgttggccatatcttttccgatggccactctggaatccttaacattcactatcatattgccgccgatttcagatactacagttaccacgccgccggttacaaagccaaggttctcaagaaaccgccttgtttcctccctgccgccaactttacgtattacactgggttcacctgcattcaccattgtcaaaggcatcattccaccttctttcttttttgatattgaggattgatttcattccccgttcttctcggttagtatattctaacttccaatagttgtcaatgttattactgataataatttctcattagcaggtagggtgagggcatggcgaggtttttgcggcgacgggggcggggaggaggggcagagaggggaagggtttttgtatggatatgttctcactcagttaaaaacgtagcgattctaacgctgcaggtttgtcgcgtgctgcggggataaatatatttgctgataatataaaaatatggtatactaacgccagttagttcattcggattacagtaactttatgtcaggaagcggggtgagtatattggcagtgggtgaatcctctgaaaattatctggagacaattttaattctgagtaaatcacacccggttgtccgttcggtggatgtggcggaggagctgggttttaagaaatccagcgtcagcgtggccatgaagaatctgcgggagcgggagcatattacggtgactaaggaaggctatatttatctgacggagtcaggccgtgaaatcgctgaaatgatttatgaaaggcatcagcttctctccgcatggctcgtaaagctgggcgtggatgagaagattgccgctgaggatgcttgtaagattgagcatgtcatcagtaaggagagctttgacgcgattaagaagcatgtaaaataaccgttatgcaaaggtgttggacagttacaaataagtgttggaaaatcccggcggcctgtatggccccgggattttttcatgtacgggcagtgttatgcggggttcagttttctttggctaaaagttcttccagagtatgccagcccagtaccgcgcattttacgcgggcgggcatatggcttacgtcctggaggcaggcggcttcctccaggtcatcgatttcctccggcgaggcctggccctggatcattctcaggaaaatgccggagaggcggacggcctcttcttttgtttttccgatgaccagatccagcatcatgtccgccgaggcctgggaaacggcgcagccgcttccttcaaaggctccgtccgttatcctgccgtcttctattttcagcctgagcacaatatcatctccgcagctgggatttacgccctccagctccagccccgccccggcaagggggtgcttgtgggcgggatgcatgttgtggtcaatgagtatttcatgataaaaagttctattctccatatcccatttttctccttacttgtcgcaggctgtgaagaaatgcctgtatttcattttccgtattatagaaagcaatgcttgctcttgcggtagatgagacgccgagatagtccatcaggggctgggcgcagtgatggcccgcccgtaccgcaatgtgatccgcatccagtatggaggctacatcatggggatgcacaccgtccacagtgaaggtgagtatcccgctgtgctgtgttccatccgcagagccaaggatccggatgccggggatttgcttcattccctcaaaggccagtacggtcagttcatcttctctttgcttcagccgtacccagccgattttttccagatatcggattgcagcttccagggccgccgcacccgcggcatttaccgtccccgcttcgaatttatggggaaggggggcataaacggcatcccggcggcttaccctttctatcatctccccgccggtcaggaagggaggcatggcttccagcagttctttttttccatacagcacgccaattcccatgggcgccatcagcttatggccggaaaaagcgaggaaatcagcgtccagcgcctgtacgtcaatggggatgtggggcgcgctctgggcggcgtccaccaccacaacagctccctgcctgtgggccagttctgtaatttcccggacagggttcactctgccgaaaacattggaaatatgggccactgccaccagcctggtccgcgcagtgacggcctgtcggatacattccggcgtcagtgttccgtccgtctcacattccaggaacttaagtacggctcccgtgcgctttgccgccatctgccatggcagaaggttgctgtggtgctccatgatactgaccagaatttcatcaccgggccgaagcttcgacagcgcatagctgtaagcgaccagattcagggcttccgtggtatttcttgtaaaaattatttcctccgggcatgccgcgttgaggaagcggcatacggtttttctcgcattttcatactgctgtgtggcatccattcccagctcatataatcctcttaagggattggcgttgctgttttcataaaaggaacgttctgcttccagcacacaggccggacgttgggcagttgccgcgttatccagataaatcagcggcccgctgcggccgaagatgggaaaatccccgcgtatttcctgttcattccagtttttcatccgggcttcctccttccagatatttctgtatccgtctgacaacggtatcatccgggattttggcgcacaacgcatcaattcctgcgcgggccatcatatcacaggcttcttcgcggcttagccccctggagcagaaataaaaaagtttttcctcatccagctttcccgctgtggcgccgtgatttccctgtacgttctcttcaccgcataaaatcagcggtatggtacggtttaccacatcgtctcccagaagcagcacttcctctttttccgcgccttccgcgccggagcagcccctgtggaaatcaatggtgccccgaaagagcttcgatgcctgatcccgcagcacgcctttcacttccatctggctctctgatttcctgccgtgatgctcggccacgtaattcatatccagcttctgcatgttttttcccagatagccgatatccgccttcatgcggctcgcatctcccgccaggtttatgcgggcgcccgcataagtggttttggcgcccagctgcagctgcagcagttctatggaagcgccttcctcacaaatcccgcccacatcattcatggcagcaaagccatcgcctaaaagctgtacctggattagcctgaccgccgcgtttttttcagcgtaaaccttcgtctggataccggcgctgccggaatccttacggcctgaaaagttttccatgatcaccgtgatgctgcttccctcctccgcataaatacagaccgcatgcagagaattttctccctgtttatattgccaggaaagtctgagcgcctcttcgggatgcgcgccccttttaattcggaaaatatccatgggcgtttcactttcccgcacaaactcatccatatccggccccatacctgtggggatttcctgaaaaccggattccagcgttccggcgctcattccccggatacaggatacgccctgcccgggcagcgtaaactgcggattgcaggacaccatattttttccgtaaatttcagtatcaatatctgaaaggctgctgtcattcatatgaagccagttccatgtcctcatgggcagcctgttaaccttcatttccattccttgtttcatttcatcctcctactgttttgcaaagcaaaatacggttcctccggcgggcagaggctttccgccttgttttgaaaaacaaaatgcaggccctctgcaggcagaaattttcttccgtctccgcgccgctatccgatgctgcctttcatttccagctgtatcagattgttcatctccaccgcgtattccaacggcagctccctggaaacattttcggcaaagccgctgactatcatagctctggcgtcttcctccccgataccgcgcgacatcaggtaaaataccgcgtcttcactgatccttccaatccgggcctcatgcccgatgtccgcatccggcgtccggatatccatggccggtatagtatctgagcgtgaaaaactgtccagcatcaacgactggcaggaaacggccgccctgctttgcttggcatccttcgccaccaccacagaactgcggaaggtactgatcccgccgtccttggaaatggatctggtattgataaaggaggaagtattctcgccctgatggacaattttggcgcccgtgtcaaggcactggccctttccggcgaaggtgattcccgtaaattccgcccggctgtctttcccctttaaaatactcatgggatagagacaggatacatgggagccaaaggagccggatacccattcaatcacaccgccttcctccactacagcgcgtttggtgttcaggttgtacatgtttttggaccagttctcaatggtggaatagcggagcctggcttttttgcccacatacagctccacgcagccggcatgcagattggccacattgtatttgggcgcggaacagccttcgataaaatgcagatcggcgccctcatccacaatgatgagcgtgtgttcaaactgtcccgctcccggcgcgttcagccggaaataggactgcagaggtacggtgactgaaatgcccggaggcacatatacaaaggagcctcccgaccagacggctccgtgcagcgccgcaaatttatggtcattgggccgtaccagcttcataaaatgtttacgtaccatggaagcatattctcccttcagggcgctttccatgtccgcgtataccacgccctgggcggccacctcttcccttacatgatggtataccagctcggaatcatactgggcgcccacgcctgccagggacttacgctccgccttcgggatccccagccgttcaaaggtatccttgatctccgccggtacatcggaccatctggcgctcatatgcgtgttgggcctgacataggttacgatatgctccatgtccagcccctccagggacggcccccagtcaggcacccgcatctgattataaatctgcagggactgcagccggaacagctccatccacggcggatcctttttctcccgggaaatctgcgcgacaatttcaggcgtcaggccttcttttacccggtaaacatccttttcttcattttttatgtcataaacgcttctgtctatatcatccacataggttttttcttccataaacactcctttccggcattttcgcgcctactgccgatacatccgcacggcctgttcgtaaaactgttcaaagccttccgcattgattcgttccaccagcccggcgtctcctgtctccacgatacggccatccaccagaatatgcgtgtaatccaccttcagggattccagaatcctcgtgctgtgtgtgatgatgagaagcgcgcccttttcattcttctggtattcctccacgccccgggataccgtgcggaccgcatccacatccagcccggaatccgtttcatccaggattgccagggcgggccgcagcataagcatctgcaggatctccgccttcttcttttcgccgccggaaaaacctatattcaaatccctgtccgcataggtttcatccatctgaagcacctccatggcctttttcatttccttccggaaatcccaaagcctcagtttttctcccctgcgcctctccaacgcgctgcggataaagctgcccagggaaatccccggcacctccagcggattctggaaggaaaggaaaatgccgtctgtcgcccttttttccaccgcttcctccgtaatatccttattcttaaaaaaaatgcttccttccgtgatctcaaatttgggatttcccatcagcgcatatcccagggtggattttcccgcgccgttaggccccatcaatacatgagtctctcccgcgttcatctgcaaatctatcccatgaagaatttccctgtcctccacgttaaccttcagtccgtttacatttaataattgctctgtcatagcgttcctccatttccgtcattttctgaccggcctgctcttctattttccctgccggcgtttccggcagacattactgcttatttcttcctttcccataataacggaaaaggatttgaacatttcctaccatttaggtatgaattgttcaaatcctattataaataccctggcgggaataagcaatataagaaaagcgatgtaattgagaatgtttctcatttacatcgcttagttaaaaaatgtatcgcctgcaaaggcgggagcacagccggcccctgcctttccgcctgcatctttgctccggttcgggctcttaacaaaaaagagcagctgttttgcgcggttctgtctgttatggcagggacaactttttctccgcaatttgcgtctgcatataaaggattaccgcaatgaccgccgtcagtacatctgccgccgcctgggaggcaatgatcccgtaataaccggcaagccgggaaagtataaaaatgcacagcgcaaagacaacgccctgtctgctgacggaaagcaccagcgcaggcagcgctttgcctgcggcctggaatacggtggtaaatacgagaatcacaccggcacagggcatggaaacaagcaaacaccgcagcatcaggctgccggaggcaataatccccgcatctttcatgaaaatccccattatctgcggggcacacaaagccagcaatcccgcgcatacaaccgaaaataccagctccacgcaaaggtcaaaccgtataattttccgcagcctttcccggttttcagccccgtaattatagcctatcagcggctgcgcgccaaaggcaaagccaaccataataagcatgacaatcatattcaccttcatcgcaattcccatggctgccaccttttccgtcccatattgcaccagataacggttcatgagggccatacccagactctgcatcagattcgttacggaggccggaatgccgatggcgaaaacagccagcagatcctgttttttcactccgcttatatggatggaaagcgtaagcttccggctctttttcaggacaaaacacaccaggatgatatctgtgacaaggtttcccaggacggttgcaatcgcggcgcctcccgcccccattcccagcccgaagataaaaacaggatccaggatgatattcaccacggagccgacgacggttccgatcatggcttccacagccagcccctccgtcctcatcaaattgccgggcgtcagggacagaattaccgcaggcgcgccgagcgccatataggtatagtactgggacgcatactcccaggtatccttacccgctcccagcagatgcaggatcggcgtccgaaacagcagcatggacaccgagactgcggccccgcacagaatcgccgcatagaagcagaagccgcttacttttttcccttccccgtcctttttctgaccgaacagcctggaaatcacggagctgccgcccaggccgaaaatatctcccagggctatcatcagtgtaaaaacaggcgcgcacagggacactcccgctacaatgctggtattctgtgtccgggcgataaaaaaggtgtccaccatattatataccaggctgatcaccatgctgaataccaccggcagcgccagcttgaaatatgccttgggcaccggcgccctttcaaataaatcgtcagtcatttttccgttcctctcttctctcaccgcatgccacaactgtactggccacggccttttcatccggaattatagcagaaaaaattgctttttgttgtgacatatgtcacaataagaaaaaaggagaaaacagtttctgaaaaagcgccgtgcagttacgatagatgcagctgttcagacagagccgcgctgttactggaaaaaatatatgaaaaaaatttatgacaggccaatcgtgatggaatatgtgaaaaaatatggcatttcccgtttttttgataccagggatctgccctttttcctcatccgctacgagaagggtgaaactatcattcatccgacggagcataccagatatctgcagtttgttgtggaagggacggtggccatatattctatcagaagggatggttcccagtttcccatcgcatccagcgatgattttatgatgctgggcgatgtggaatttgtcaaccagagcctccccgcactgtttgcagaagccaaaagcgatacagcggcagtggcgctttccctggatgaaaacaagcctgcccttgacagggatcttgcctttctccactataccctccgttctcttgtaaaaaaaatagagctgtccacaatgaatgaggccgaattcatcagccttgaggacaagctcctgcattatatccaatattgctgccatgacgggcttttggtccatatcggtaaagcctctgaaaacctgcactgcagccgccgtcagctgcagcgggttctcagaaagctgaccgaacagggaatcctggaaaaaacttcgaagggggtttaccggctgctgcccacacaataatttcagccttctgccccgtttcctctaaagtccctgaaaagtgtccgtatactccattatgggacggccatcctccgtaaagcccagcggcagaattacataacgggaatcgtggtaatctttaccgttccatctgtccgccacataataataaaccgtcttcccctccttttccacgggaaggataaaagccggctgtgtacggtaggtggtgctgtctccgatatccgtcagcgtactccagcgtccctccatgctgtcggcgcaggcatagcggcactgattgggcgcccagcccgtgcagaaggaagaaaacatgtagtatttccccgctctttccattaccgcaggggcttccctgtattcgccctgccagagcttatgtaccaggcagtccgcattcaggtaatcatcggttagcctgtacacatgcagatccgcattgtccctggaagcggaaataaaataagcgctgccgtccttatcctcgaaaagcgtacagtctcttgacatatagccaaagggattgaagcaccccagataggtgaaatccccgtccggcgtatcacagaccgcgatgccgcaggcggcgtcgttataatccactccgttttcaacatgcatccacatgacgaatttcccgattttcctgttatataataccttcggacgctccacattgattttgccgcctttttcactgcgcagcttctgatctgtcctcacccggtgctccgctgtgggtgactcagtggtcaggacgtgattgcaaaaggtccagttcagtaaatcggcggacctgtatacacttacatatctgttttccgtgcggttttccccataccagtaccagttgtccccccatttcagcatgtgcccgccatgggcgtggagaatattgccttccgtatcataccaaagttccccatttgttaattttgtattcatttctgctcctgtctcccgctgaagcgggcatgcggacagagccgcataattattaaagtgtaaggatggcggggccttccttacagcgtgaagtttctgaaaccgggagcggcattttgatgtctccggtcttttttcacatctgtctggctttcattcaatcacagatcctaattatctgcgggtaatgaatgaaaaaattctttacttctccataatgctatccagcaaccgcctgaattccctttcaaaccgttcatcatcctcagcagtccgtttatgcggcccctttccatgatgccttgaagaggcccgtctcgccttttttgacagatgccgttccagcagcagctgatccatattatcctgcgtataccggattcccgactgatgtatcccgaatgcgcctttcccaagcgccatggccgccactccataatcctgcgtcaccacgatatccccctttttacaaaggtttaccagcgcaaaatccacagcgtcggctcccgccccgattatcctgatttcactgtaatcagaatgcagtacatgattggtatcacacagcagcaccaccggaattcctttttcccttgccgtccgttccacaatagtaatgacaggacatgcatcggcatcaactaagatttgcatttttccgcctctccataccaaaacaacaggaattttccctcaaagctgctccataccatcttccgtatcatcggaaaatagaaggaagaaaaaagcatctccgtaaccgacagcctgactgcaatggcaaacaacgtttcctcatatgaaaaatatacatcctccctgctatcgggaagattcaaaccgcaaagataggaagcctgctctatggaaagcacagacagcgccttctgtttttcttctttggacaatgtgccgaaataaaagtcaaaataagtattttccttcccgttttctctcaaaagctgataaataaatgaaacaagctcctccctgctgccttctatcaccttcatttcccggccgctatatctcatggcctcctgtagggtatccggtaccatacatcccactgctatcaattcttcttttttcatatcggatcacctgcctccatggtatactttcctgtttttcgttggcttattttctgcgcgcaggcctgcgcagctaaatgcgctggcctgctaaacagttacgtcttttgcataaaataccaatgtcatattttctttgatttcttcggtccggccattttgatgatatcccattttttcatacagatgacaaagcttctcttcctgaaggattgtgtccagctcccagcgcaaggccgatggatacaagccttcggccatacggattgcctgttgtgcataaccatttccctgatattccggcaaaatgtaaatctgtttaagtatacataacgtctccaggtgaattaccctcaacgcaccgatatgggcttttccaagacagataaaataataatctgaaaattgttcccgcagccttctttccgtcttttctattttttctgcgccggggctgaaatcataatccctgtacttttccagcagctcccggaaacattttaactgcatctggtacagctcttcacaatcaatgattcccgccttccgcagagtcatatcaaagccgtactgctgtccctgtctgccgcatccctgcatcctgcagtcaccgtcttcctttttcatagtagcctcactacttattcacctgcaccaaacagctctctcgtcttcttcatcctgtccactatccgaacgccgaagggacacctggattcacagccgccgcactggacacagtctccggcattcgccgacagctgctcataatgcgccttcaccgtagccggcacctcttcctgcatggctgccagatcgtatagcttattcaccatggcaatatcgattctgaccgggcagggtgcacagtgaccgcagtaggtacactgtccggaatatgcatgctcaggcgcagaagccagcacgctggcataatccttctcttcttcggtggctgtctcgtatgccacggccgcatccacatgctccggcgtatcaaaaccagccatcacactggcaaccgcaggacgcgtcagcgcataatgcagacactgcacaggagtcagcgccacaccaaaaggagaggtttccgcctggaacaaacggccgccggcatagcccttcatcaccgttatacccacgccctcccgttcgcaaatacggtacagctcctcccgctcaggtgcgataccgcttagctgctccgcataagtttccttgaaatactcattcagatcctcactggccggaagcagatcaaaggccggattgatgctgaaaagaagcatttctatttccccgctcaaagccgccattttagccacatccgggttatgggtgctcatgccgatgtgacggatgacgcccttttccttcagggagcggacatactctatgaactccccgttcattatccgttcaaactcggctttttcatccacaaaatggatcatccccagatcaatataatccgttcccatccgatccagcaaatcctggaaagcaatttttacctgctccaaatcacgggtacggacatactgcccgttctgccaggtgctcccgatatgcccctggattatccagcgctccctgctgcccgcaatcgccgcgccgatgttggaacgtacctgcggctgggacatccagcagtccagaatattgattcccagatcctcacacctgtcaatcaccgccttaacctcttttgcatcatgccgttccagccattccccgccaagcccgatctcacttacggaaagccctgttttcccaagttccctgtacctcatttcctctcctcctgcttttatgctgcttttatactgcctttcattttcgcatttccatcccgccgtatttgatgaagagcgaaatctcttcctcatcgtaaggcgtaaaatcctcatgatacaaatcatgctgccacagtgacagatccagcccctttacttcccgcagatagtcccacggcaggtagaactgtgattttccggccaccagcccccaatgatagctgccgatcctgttctcataaaaatacggcaggagctccctgatattatttcccagtattcggttcagccactccgtattgaccaatggacgtccttcctttttcagttcctccaccacttgctttacccggtcaaaattctcatattgatgaaaagtaattatatcggacagctccacggctcgcttctgaatcggctccagctgcgcctccccggatatgccgaacccctccggatatgcccagggcgccgctgtcagcggctgatccggatcaatttccctggcaatctcaaatacacgctccatatactccatactttgcgcatgcctgttgctgttacccggttcattccataaatcccatataataatacgcggatcctttttataacggctgataatttcctctgcaaatttgtactgaggctctctccattcttcctcatcaaataaaatccagcccgttttccgcgtttccccggtaaacggattctccgcctttcccccgtgatgaccgatatcatagggctgccatcccttccccatctgcgaagggaataccggacttggcctttcaaaaggcgcgcagtcattaaacagcaccggcataagcgttatctcatatttttccagcagcaaaagcagttcgtccagcttcttaaagaaaagctcccgctcaaaataccaggcctggaaaggcatgaacatccttatgctgttcattctcgtttcccgcagaagcgtcagctcccggtcaacggaaatcattacctcctcccgcgtatcatcctgccacagctcgatattatgcagcgtaatcgcaggcacataattacagcctatcagccatgggtgcccgtcataccaggcattgattctttcccggctccatctgccgcccatttttattcccccttccatgtcagacacggtgttcttaatttcagtatattatatgtgaaaggaggatacaagcggaaaacggaaacaccttgattttaagaagggtgttatatgatatggcccggcaacagttatataacgaaaggatgagtttgaaaaaaagcaaaaaagccccggacattccagcccggagcaattttaattatttttcacttttcagttttattggaaacataccatattcttcattctgattccactcattaatggaaacaacatcaaccttttctattagctttactttgtcagaaaccaaatcctgcaagtgaaacggcagtttcttttttaatcgatttcttatcattcgccttgataccgaatccccatttggatattccaacacataaacaaactctttcggcttctcttttcccattaagtgcatgtaatgcaatgaatcatagaatttttttaccacattatttattttcttgtcagctcccggctgaaaagcttccggttttgccgccccggatatacaggcatttttatattccatcataattattttcttttcagtttctattactaaatcaacatcatttaaactgccttctgtagaactatatgcctgatgtatctcatctgtcgcccataaggctttggtacagtcgaaactatagcatccattctcttccgtaaataccttcttcatttacttctccattatcaggaattataaatttcatctaaaagttcattaaacgatttaatgatcagattattcttcaaatcctcaaacctgccattgcaggaatattccaaattccttttttcatcatagctcacagaatgaaacaaaacactatcctcttctcttctatgaatttcaaagtatttcgcaagtacataatcatgcgtggaaataaaaatctgcacgccgtccctttgcagctctaacagcatatctgtaataatactaagatataatggattaatattggcttccggttcatcccagaaaagcaccgaacctttctccaacgtgccgttttttacaagctgccagagaagcgccattttccgtattccttctgctaccaggttaaactcctgcctcgaatttcctatttttaaataaaattcatctttctggccatcataaacaactgtcccaccaataattttttcaattgcttttaattttttatcacgttctgccgaatttcttcccacagatatatctattcttgcagagttgataatatcaatataggtatcatcaaatttaacattattcttttcgacagctgccgtcagattatagctgttagacaaaatttcttttgccggtataaagatgctgctaatatccttaaattcattttcccaggcttcttctccacaaatctccgcatcccatttttttgttttattatgaaacgaagctgtaatagtatgatttttttgttttttctccgacaaagcagacactttgatttctgaattatgatttcccggctttctggtaatcaatctcgatattttaaactcgtccggaagcattgtcctgacaattttagccgagaaagatgtttttggatccgccgcctggcaggctgcatagaggattttgagaatatgcgtctttccggttccattttcacctataaaaatgtttatcccttcatcaaatgctatctctattttatcaaaaacagtcacattttctaattctaaatgtctgattttcatttcaaatcctccatgtcacaacgatatcttcatactatcaaatatgactgaacatagcaatcttaattctatcataacttaacggcatcctctcaaggaaatccgccttcaacgataaattccccggctcccgcatcagttccatgcgataaaggcattaaatacgccaatctgctaaataattatgttatgtctttataataacccatacctcgcagatgaataagagtaaatacatcttaaaaatcccataataactgacaaattaagagaaagtgcagtcattccaaatactttttttcaatctggataatatccaaccgcaccttcccaatccgcatccatcaatccaacgtccattcccacaccacagcctcataagcccgcagcgtcagcgtatccgcccattgcgcatccggataatttgcgataaccagctccggcctgcgccccttcatctcctccggcagttcccaggccagttcttttcctgtaaaattacatgccaccaaaagccgttccttttccagcccccgttcataaataaacagctcctctgactccggctccagcaggcggtaatccccgtaaacaattattggcctttccttcctcaaagccaccagctttttatagaaggaaaaaatggaatcctcccttcccacctgctcctttgcattaatttcatggtaattgggatttaccataatccacggctttccggtggaaaaacccgcattttccgaatcctcccactgcatgggcgtccgtgcgttgtcccttgacttgtagcgcaggtagccaagcatttcctccctgctgaaaattcctttttccgtcagttcccggtaagcattgatgctgtccaaatcccggaaatccgaaatatccgcaaagggcgcattggtcatccccagctcctccccctggtaaatatagggggttccctgcatcatatggctgcataccgccagcatcttggcggatacctcacgatactgtgcggaatcatttcccaggcgtgacaccaccctgggctgatcatgattacaccagaacaggctgttccaggcctttttgtacagcccaccctgccaccgggacagaatctccttcagcttggaaagcttacactttctgtccgtccacttatttccgttttcgtcaaaatccagatccatatgctcgaactggaataccatgttcagctcttttccgtccagcgacgcatatttcagcgcttcttccagcgtcacgccggagcattctcccacggtcagcgtatccctgccgtccaggacctcccggcgcatctcctgaaggaactcatgcacccgcggcccgttggcgcagaaattaaaggccgcatagccgttcagccccgccggcccgtccggatacgcaggatcctttgatatcaggctgataacatccatgcggaacccgtccacacccttgtccagccaccagttcatcatccggtatacttccctgcgcaccgcctcattttcccagttcagatccggctgcttcacagaaaaaagatgaagataatattccccgcttttttcatccttttcccaggcggagccgccgaagcaggaaccccagttattcggcgcgccgcccttctcaggccccttccagatataataatccctgtaaggattctcttttccctttctgctctccacgaaccagggatgctcatccgaggtatggttcaccaccagatccatcaccagcttcattccccgctcatgtatctgtgaaagcatccggtcaaaatcctccatagtaccgaaatccttcataatcgcctgataatcactgatatcatacccattatcatcattgggcgactcataaaccggggaaagccagatcacatcaacacccagctccttcagataatccagctttcccgtaattcccttcaaatccccgattccgtccccgttgctgtcacagaagctcctcgggtatatctgatatacaacactttccttccaccaggttttatccataccgtacccccttcttttcatcccgctgcgtattctatccgcatcttgaaaaatattataccattttacctgttcagcatccataccccaaaattcagatacgccgcaaacaaaagccagagcaggtagggtatctgaagataagccgcttttttatcgatctgataaaagcttttaaccatctttgccgtaagcaccagcagaagcagcagccagaaaaaggaaaaaagcctccagccaaaggcaaagaaaataatactccagaaaaaattcaccgcaagctgcgccgcatacagcttaagagcctgcggtttttcctgactttcggaacaccagatcatggctgaactgattcccattaatatgtacaaaatgctccatacaatgggaaacaccactcccgggggcgacagcggcggtttttccaacgtctgatacgccgccatgccgttcctgcttaaaagggcggaaagccctcccaccgcaagcggtatcaggatcgctgtaacataagtagattttcgtctgcacataataacctccacactttgttccccggcggcagactggcctgccgccggattttctttcttctgtaaattgtatgccgaatcaggtaaaatagccgcattttcgcttccgggaaaaacaccgtgggagcctcgcttcccgccatggccgcagacgggacagaacagttgcctgaattcaacattttctgataaaaattgcgaaaatggtttgcatattccgacaaaacaagtataattgctaagtaagagtccttttttggataaaatggagcagacatgacaaaagaagtaatcgttaaacgtaataagtacggaatcaaactaattctcgacaatcacataccctttccggaactgttgcagcttatcacagataaattcaaagaaacaggaaacttctttaaagatgcccaaatggccctttcctttgaaggaagagtactgactcctgatgaacagctgcagattatagagaccattacggaaaacacctccatccggattgcatgcatcgtagatgacgacagcgccctggaggaacggatgaggacacagctggaggctgctgaatatgcgggaatgccccaggctgtcacagcggaggagacctctactgatttttacaaaggcaacctgcgttccggccaggttctggaaagctattccaacatcacgctcatcggagatgtgaatccgggcgccaaaattatctcccacggaagcatcgttattctgggatcactgaagggaaacgcctgcgcaggagctgccggagccggcaactgttttatttttgcgcttgaaatgaagcctatccagctgcagatcggcgatctgatcgccaaaagcccggacaaagaaaagaacccccgcgcactcaggaaaaaggagaatgccgccggttcttactctccccagctggccaccgccaaagacgggaatatatgtatcgaaccggttataaaagggtgcttcaacaatttataaaaccaggtgtaactgttcaataccctcacagttacaaccagatttccaactaacatacagaaggaaaaccctctgttttcgcagagcccgtattttccttcggaaaactagcaggaggatttagttaaatgagtgaagttattgttatcacatccggaaagggaggagttggcaagaccacaacaacagcaaatgtgggaaccggacttgccatgcttaataaaaaggttatcatgatcgataccgatatcggtttaaggaatctggacgtagttatggggctggaaaaccgtatcgtttacaatctggttgatgtggtggaaggcaactgccgcttaaaccaggcgctgattaagcacaaaaaatactccaatctgtgcctgctgccttccgcacagacaagagacaaggattccgtttccccggaacagatgaaagctctcatcgatgaactgagggaaaattttgattatgtcctgcttgactgcccggcaggaattgaacagggctttaagaacgccattgcaggcgctgaccgcgcatttgtggtaaccacgcctgaggtttccgccatccgcgacgccgacaggatcgtaggtcttctggaagccaatgaaatgcagcgtattgatctgattatcaaccggatccgcatggatatggtgaagcgcggtgacatgcttaaggtggaggatgtcaacgaaatcctttcccttcctttaatcggcgtggttcctgacgatgaacagatcgtggtatccaccaaccagggcgaaccgcttgtcggctccagcagcatggcgggacaggcatatatgaacgtctgcaaacgtctcctgggcgaggaagtgccgtttttaaatcttgacgcgaaaaggggcatgatgtccaagctgaaggatatgttcaagaaataataggggggctttaccatgagattaatggatttattccggaaaaaaagttccggcgaggtagcaaaggatcgtttaaaacttttactggtctccgacagagccaactgctcccctgaactgatggaacagattaaaaatgatatcatccaggtcatttccaaatatatggatattgacgcccagggactggatatccagatcaccgaaacggaatccgaaaccggcaacggcgtggttcctgcgctgtttgcaaatattccgattaaggatctgcataacaggaccggaaaataataaaatcggaaaaagaaatgtccgccgtcaggcgcacattgagaaacggcttatttatggctgccgcagccacaaataagccgttattctgttagcgcttcagtttcagcacgacctgtcaaccgaataaaccgcttcaatattttcaatgggcacatcgccctcaaagccctggcttgccatcagaatatatcctccgtccttccccagcaaatccatgaaccttcgcacctcccgcttcacctcctccggttttccgaaaggaagcagcccctgggtatcaataccgccgtggaacacaatttttccattgtatttttccgccagcgtctccacctccagccccttcaccttctgcaccggttccagcgcatccacgccgcattcgatgaattccggaatgagcggccccacggccccgcaggaatgctgctgataaaaggcgccgtactcatgggcaaggtttaccagttttttagtattttccttatagaactgcctccacatatcaatggaaaacagcaaagaaatctgcgttccgtagtcatcatgagggcgcaggatatccacctttccctcacccgcctcaaagatcctgcggtagtattccatctcgaactcattcatccgatccagaatccgctgcgccgtctccggctcatccagcatcagcatgaaaaactcatccatttccatcaaaaaggttaccatctggaaaggcccctcatgtcccacgataatggccttatccggatttttttcacacacttccctgacagcgctgtagtcaaaccagtccggatcagggaatggaaccgcatccgcctcctccaccgtctccacgccgtgcagcggaaaataagtggttgttccataggtatccatggccgtcgtatgcagcgttgtctcatatccccaataggacagctccacctgctcccccttttcgtttttccaggctttcagcggcggcccgatatatctgggggaagctgtcacaatatctatttcatacttctccagcagctgatcgtattccgtaaaaccataatgcttcagaagcctgtccgtcaccggccccaccgcctcaaaggccgccggtatccgatccggcttccgatgctccataaccgctctcactctctctttcgacgtcatatcccaattcctccttttcccgggtcttcctccattgatccatatcctgtctttaaaatatgtgccccgtccggtttaccaatattttaccgtccccggccgccgcccggaattcccaaattcatcacttttcttgtaaaaaaagcaactatcagacttgcaagccccggcaaaattatatagactggataatatcatattaaaatatacaggataaaactatgaacgcaattgataaccgtgacaatttcccttcctttctttatagcgcgccggaaaccgacagtgcccggcttccgtttcttctccatgcagttcgcatgggctgtggctttcaggaatccttttttcaaatcaaccgggataatagctacccgtattttaccgtccattttctttttgacggatgcgggctattccacattgcgggtgaaaattatcttctgaaaaagggggatgccttcatcatccccgccggggaagcccacagctactccaaccgctccgaggagccgctggggctcatctggatagaattatccgtgccgggctgccaggagctgtccagctatttccacctgcaccgcatctacaccattgatgcctcccacacggaagcgccgctgggccgcctgatttccatccttcacaacagaaaaaagggcgttttttcaacgccctttgagctgtccggcttatattatacgtttctgatggagctgcttgacgccgcgcagacccaggtatccccacagcttccggagctgctcaccgcggccctgtattatatcggacaccattttacggaggatatttcaatcggccagctggcggactacctccatgtcagccatacctatctgacccgcattttccgcaaatacatgggaaccacccccataaaatatctgaacctgaaacggctggaatacgcctgcttcctgttagacagcagcatccttacctgcgagcagatcgcggaacgcatcggcatgtacgacgcatcccatttcaaccgcttcttttcccagcagctggggatgcccccttctgtttaccgcagccggaagggaccttcctccccgccgccggcgacctgacacaaatatacatcaaaaatcctccagaaggattgatccccaaagtggcctgcccgatcttcctttaatcaaatggttttcacttatataagctaataagatcattcacaagcacttcatcatttgtaagtaggattttattattgcttaaaaatccatccattgattggatcgttttgtcggtcacagagattttccattttttgcttaaatcttttttaaaactaatataaatttcattctttattggttcatatacgattgtgcacagagtattcttctgactggttttatttaaaatttcaaaagcttcatttattccaaagctatggatattattccggatatactcataagcacaaatatatctgtcagcaccaaggccatatacttcattataatttgtttcctcaaatttcccatttgggaaattggtcataacaatgaaatcattatgaacatggcttattatatttgtaccatttccttcttccagaataaatgcatcaccagttttatcagcaatcatagtatgcagccccaaagccggaaataatggattccttggatatgagattactcttttattaagaatctcaaaaaattcagatgcttttcttgttttctttagcgcctcatcaaaaatatcaaaagcaaaccaattattttcgtcacaacttgctttaaaacccggaccatattctactgcctgagttaatataaaaaggccctcactattaaaataagcgatatccctgtatttattttccaaaaaggctgaaaagtaaaacaggttcatatcattgtaactactgatttttaattttaaatcaatatcattcgtatcgaaattcataccataaacagctttttcctgatggtatactgcaaaacttgtacacattttgaaccccccattaatatatagttgatatatgatatgcccaggctatttagagaagcatttaactatttctacggaaacttctccactttcttaaacatatgtattatgctactataggaatttcaatggttcaaccttaatcatttttcagattcaaaaatgctcccttcaagcctatgctttaactttcttatttcttcggactctttttgtttttcttcttcatcaagctcttgaattacctgtgtattatctactcctgaaagagcttcaagtaacttgcgcatctcattttgaaacaggggattcgaacccagggacaggctcactactaaaacgagaaataatttatatatcttttctttcactcatattcctccaattcaatatctgctttgattcactctcataataaacagatggcttatacccgctatctatttgcatacaaaaagaaagccattatctgattctaaaaatggcttacaatcactggcacacttgtaaggatttgaaaaggagttgcttcaatcgtcgagacgtaccttttgattaattaatgtccattcatcaggcaataatctaaaaaaggccgaaaagaaataaagaaaaactaaaataacaaaaagaaacaggctgaattcttgtgtgatagccgcaattacaggtattggacatatattcttcgttataatttcagtatcagaattattttcgctcaaaaatgaagtcttaaaacaggtggttttatcaccgccttcattggaaaagctactttctgaatttgcccgcgcctcgattacagtggtcttacctgataatccataaagcttgtaattactgcaaaagagcacattcatagttaagcccgcagcaaaaagaagcataatgaaaaagaataaaatatgggataaatgatttttcttattatttatttccattacacttcccttcttagccgctgcagcaggaaagcccttcttcactgaccactgcctcatccagcttccgttccccagctaactctattatcagataaagtataccacagtttcaccaggccgtaaccactaacttatagccgcagctgcgttaaaaatcagccgtatcatcaccgtttgccgcacttcatcccccggtgaggaaaatctgctgtgaaaagtagatcaggcttcccaccattttccccagggccacggaaaggaccgcaaaacccagcccatgcctgaactggattctccgtgcaaaaataggtatggtattcagcatctcagcaatagccaacgccagacagcccacaaaaatcccggcgaatacgccgaatacgattaccgccgcagcgctaatccatttccacaggctgtctgtaaaagagccgaacacctgcccttttcgcacccattcccccacatggcaggaatactcaaaaacgcttataaaatttccaaatagcgtgcctgccactaccatttcctcatacaggaaaaccttcttgctggtatgggtctttcccgcaaaacggggcaccaggccaacggaaatcaatacggtaaatacccctgcggataccagaaagccgaagctcagtccaaagacagccataaaaacacttttaagaaacatcaatggtctttccctccctgtccgcagtttccaccaacgcattgttcacgtcatcctcatatatgcgcatttccacctcgataggcgtggggtcctttgtaatccgccttccgccgatatggttgaagaatacgataatcccaatagcaagcccgatggagtatgccacctccagtatggtaaagccgtctgacgcctctcccgctatcatttcataaaccttcatgaataccttattgatcccgatatcattatgaaatgccatgattgtaaaggccgttccaaaaaaacagataaggcagacgaacgcaatcttcaaccactgcgccggccccttttcccgtttcaccctgacccgttccataatgatatccgtctcgcccaggttttccacagtcagctcaggatacagcttctgaagggattcgatgattttcatcacgctcaccacctggcgctgaggcttggtgtccctgaatttatatatcttcatggcttttgcgtgagccaggatatccttattcgcacataccagctttcctaaatcagaaagctgcacatcctccttttctacctccacattccgttccagcttcaggtataaagtttcctgtgatgccataccgccgcctttccggccggtcttttacgtccgtcgggaacgccgcgcttcccgcctgtacaatccggcctttcatttccataatttcgctgattcattcacacgttagtaatatggaaatttttcttttttatacacattctcctgaaaatccagtgatgaaaaaatttttcccatgaaaaaacagcagttgatcaaactgctgcttttccaatcatcatcatatcatctatcaaaattaagtagttgtcttagttggagaacatgtaagcggtggaaagcttaacgccggaaccggtgttggtaatatatgtatagatgccaatcttagtatagttgccgcttaccatgttgctgtaatgtgaagggcttgccttcaggcttgcgaatacgctgtctgctgcggtgttctgttcttgctctgaaaaaccgaagcttccgtatgtaatataggaaaggttctcgccgcgccatttgttggagcttatcatatcgcatccacttgttccatcgggacgggtatggctccaaagagatgtaatttcttcacttcttactgctgcgaagctgtttaattcattgtcaagtgtcagtgcgggaagtccctgctctgctctcaaattattgatatctgcaagaagtcttgcattcattgtcattgtctgatctgctgttgctgcttccgctttcattgtggatgcgggtgccatagttgttacgataactgttaaaactgctaatatggtgatgattgctttcttcattttccttcatcctttcaaatcgtgtcgattgaaaaatgatggaaaactactaggcatattcggttatttaaaagtagtgataatccttcgattatcttacagtaccatgcggtaccggcagctggctgccatcctttctgaagggaaggccctgtagctttgcgtccttacttttcaataagtttgccaaatgtagttttcacgcctttttcaagtgcaaaggcctgatagtaaaaaaaatagtcttgcgtctgtaaggagaccaaggctatcattgcaaatacatacgcttttactatgtatcaggcaactggctgccaacctctcatagagggaaggccctgtagctttgcgtccttatctttcaataagtttgccaagtgttaaattagatgtatatgatgattaaatgatgtatgatgatttatctaacttcatactacacccatacagttaaaaaagcaagtatatttttaaattttattactttatgtaactatttactaattgtgaagggacagaacagctgcactttttattgcagctttggaaattacagccccggacccggctcatgcctgccggcgcccgggtccgcgcctgttttccagcggcttcatctgtttcatttcatctgtctggcttcatctgtttcacttcatctatctttatctgtcttacttctcttacttcagctgcctgacttcatcaaccacgccatgcacgacaaaccgccccgtgccgccggcttttccgtggcaggtggacagcgtaaccatatccggccttccctgcgtggacgcttcctgatatcctttaaaaagcgatttccgaagtatcatatccagatagctgtcataatcctcgtccgtataaacggactgataggtatcgctgccgcttaccgtcgtataataggaaataatccggtatctgaccgctttatcttccgtatagagataaaaccagggattcccgtcggccatcccctcttcctggataaacttcttcagggatccgaacatggtgcggttcttcatgttatgcccgtaaatcaccgtattcctgtccgacagatccggtgaattgccggcatccataaatatgcagcctgcgctgttcttctcaccctcaaaggtcttataaagatacgcctcattatccgccccctggaccaccggataattcagttccagggccgggatatatagccagtatctgaagtcctgatttttatccttcagcgcttcaaaatctatctccggcataaaaaaatcatcctcaggcgcatccgtcaccgtttccgcagcggccgccgcatccgtattcacatattcctgcagctccttatattccgccgctcccttactgtattccacaaaaataccgcccagatttacgcaggccacgataaggacaacaattgcgcacaggggaaccagaattctaatccattttttcatatgtgcctctttctttcagtgcatatttaaaaattcatcccacagacaaaagtaccagctcaggtaaccgtgaaagaaccgaacggttaccctgtctgactttattatataccctgccgaaatcctgatcaatgaattttcagcacaccagctgctcccgcatgcgcagcaatatttttttctccagcctgctcacctgtacctggctgattcccaggaccccggccacctcagtctgggtcttgtcctggaaatagcgcatctcaatcagctcacgctccgtctcactcaggctgtccagcagctggttgagaagcatatgatccagaagcttttccttttcttcgtccaggcagcctgactggcagtcccccgccgccaccttgtccagaagctgtacctcattgccgtcagactgataaatggtcttataaatggattccacctccacattggcctccatagccatgacgatatcctccttggcaatgcccgtttcccctgaaatttcctccagtgtggcgtccctgccgtactgatggcccagccgctccgcggcctgctttatcttccaaccgttttccttcagggtacggctcaccttaacaagaccgtcatcccgcagaaaccgtttgatttcaccgcttatcatggggaccgcataggtggaaaaacggacgtcaaaggacagatcaaacttatctattgccttgatcagccctatggtcccaatctggaacagatcctccatatcgtatccccggcctgagaagcgtttcacgatgtgatgaacgagtcccaggtttttctctatcagtacttctctggccgaattatccccggcctgcgcctgtgcaatcagtactgatatttcctccatgcactactcctcatcttccgaccaggaaagagttcccagcttcttttccatttttacaagagttcctcttcccggctcgcttgtcacatccaaatcgtccataaaggcctccatgaaggcaaaacccataccggaacggtccatatccggcctggtggtaaacagcggctccatggcctgctccacatccgcaatccctctgcccttatcttcgatttcgatatgtaaaacatctccccgcaggcagcatctgacctccaccttgcccggctcatccccggaccagcccgcatagccgtggataatggcgttagtgaccgcttcggacactgcggtttttatgtccgccacctcctccagtgtaggatcaagcggtgtgatgaaggcggctacggccactctggcaaacccctcattttccgaaaccgcgtcaaattccaatttcatttcgttgttcatttctcctccattctgccgtctggcggcatctgcaaaatgtaatcccaaagcagctgcaaaacgcagggcagccgccgttgattgaatgtttcattccatgatttccacaattctgtccagcccggcaagctggagcatacgccggatctgcctgcccgcatgaagcacaaaaacctttcctccgaagcaggaaatgagcttgtatcttccaatgagaatgccgattcctgagctgtccataaaatgggtgtcctcaaaatcaaagaccacattgcccacctgggattccaggatatagtggtccgcatttttacagatttcatcggaacggtggtgatccacctcctccggcatccggatgcacagatagttatcaataatttgataatcgcccgccatccttgcagcgtccgccacctcggcctggctggtcaccttcagctgttcattctccctgctattcattgacttaaaatcctcctccatatgtttctcctttctaacagttactgccagaaccccgtctgaccggcgttaaaaaaagagaacctcatgcatacgcatccggccagtggccgtgcgtccatgaaagtcctcttttgtaagtgatatttaattggatatctattttttcatcctggagttcggcatccgccgtttcaaaaacggctcaggattccagctccttcagatagtccttggcccggcgggccttttccgtattcgggaattgctcaattacctggttgtatattttggcggcgttcttgctgtcgccttttttcttataggcgttgcccaggataaaaagggcgtccccattggtttcatcgtaggaaaatgccttttccaaatccaggatggcgttctcgtaatctcctgccttgtaggatttattcccgctgttcgtgtaagcctcgctaatcttgggacccacagtctccagcagcttggcgtacagattcttatatgcctcggaaatcgtatcggactgcatggcttccttatcgattccttccagcgcctgggatatcttctccatatcctccggcgtatccaggtaggtatatgccgcattcagcagatcctcaacagtctgcagcgtaccgtccttacctgcatagacctccagctccgaattcagttcatcattctttgcagtcagggtatccagctgcttctgcatatccgtaagctctgcatttttcttatccagctgctcgccgatacttctgctttcttcgttcagctgggccttcaggctctggagcctgccgggaagaatcagggtcagggaaacagccaggccgattgccacgccgccaagcagataaagaagtccggtatagttctttttcggctcctttacggcaagcggctggatgatggtttcgtttccgctctgatatttgataacatcctcagttttcgcggccttgtggacatttttcacgccttcgtccacattcagggcggcgttgacctccttcatgtaacgaagcgtcatggtgttgcccacatcaatcctgctgcacttcacaagctcccttttcgccttgtcccaatcctcattatgcatatgaagaagggccagaagctgatgggcgcgcaggaatttggaattgatggaaagcaccttgcgaagctggatcaacgccagatccaggctcccctgcctgcagtacaccagggcctggttgtatttcttaatcgcctggttcaggttttccagctggctggggctgttctgcacagcttcgatataggcgtcggcaatattcttctccggctggagattcttgctgatgacccattcgctgagggcatccacggtttcacccatctcaaaatatacgagtcccagaaggttcctcgcttcaatattcatcttattcagtttcagacattccgtcaggcttacaactgcgcctgaaagatcccgtacgttcgctttctccagaccatcattatagtaaaaattggatacgctgacgaccttcttataccgcgccacatcggcgccgcagttcgtacagaaatcgtgttccgtaagctctgcgccacaattataacaattcataacggcaatcctctattcctctgtgctctttgctggtttcctgttcttttcgatttccaccagcaggtctgtcaggtccgttaaatcatggttatatatggcttcctccacctcgtctacttcaaggctgggatgaaatttcttcagttcttcctcaaaatctatcatcataaaaacacctcattctgccggcgcatccgcaccggatatggaaagctgctgcagccgtgcgctttcttacagctgctgcttctgttttcttttctcaaggtatgctttcaactggccggccagatacaggctccctgcggcatagacctcgtcctcaggccgcttcttttccagcagcgcctccatggcctgctccgggctgtgatagagccttacctggttccttccgctccagagcgaatccagctgttcctccgtcaggcttcttgcgctgtccagccttgcaatggccacatcctcaaaaagcccgctgtccacaatacgctgtgccatcggctccacccgtttgtccgccacagcggaaaacagcagatgccttttcccacggcagccgtcctcccggacgctttccaggaaagcctgcataccatcttcattgtgggcgccgtcaatgaatacaccaggcaggacttcttccatccggccttcccattttgcctgcgacagcccgttttcaacctgctgcctggtaaccgggcagcttcgtgagagcacctccagagcgcaaacggccagcgcggcgttctccttctggtaaactgccctggttgacaggctggccctaatatattcataatacccagagcgcatggaaaaatcaacgcttttattcttaaatttaaataaaacaacttgtttttctgacacaggaatcacttccgccgacatttcacgggcctttttgacaataacctcgtttacctcttcttcctgctcccaaaatacgacagggactccttttttaataatcccggccttttccgcggcgatttcggccttcgtatttcccagatattccgtatgatcaaggccgatgcgggtgatgaccgtaaccagcggtttctcgataacgttggtagcgtccaggcgtccgcccattcccgtttccagtataatatagtctgcccgtttttcctgaaaccaaagcatggatatgaaaaacagcatttcaaaaaaagtgggatggtattcctcatgatttttttcacaaaaggcctttacgctgtccatcacctgattaaaacagcgggcaaattcctctttggagatcatttccccgtcgagccggaagcgctccctcacatccaccagatgcggggaggtgaaaaggccggtcctccggcccgcgccgcttaaaacagcattaatataggaacatactgatccttttccgtttgttcccgccacatggatcaggcccgaccgttcgcccggccttcccagatattcataaaaccttcgggtgtcctcaggtgtatttttcttcgtaaatttggggatctgcagggcataaaccactgcctcctcgtaggtatagctctttttttccatcattatcttctgcctcgtgtatttctttaggacggcccgtactccgaaaccgcagcgcccacactgcacagggccgcctgtgcggcttcaagcaagggggcggaaaacagccctgcgcactatgcgcaccctgcttccgccctgtaaatccatgataccctgcacggtaccgtctgccgcttattttttcagggcgcccagacgttcttttacctgtgccatcatctgtgtgtatttttccagcttttccttttcctcagcgattttgctttccggcgccttggacaggaatttttcattgctcagcatgccgttgacacgcgccagctcaccctgcagcttcttttcctctttttccagtctttcgatttcctgggcgatatccaccagctccgcaaaggggatgtagcaggtggcccctgcgatcacaacggaaaccgcatcgtccgcaatgcctgtccggtccacctggacggttacctgggaggcataggcaagggaagcgaagaacagctttccttcggtaaatgcccgggtgatatcctccttgtcgcttactacataaacatgcgcctttttgctgggcggcacgttcatattgcttctcacgttacggatgccccttacggcctccttgatgatttcaatatccttctcctgcgccgcataattccagtccgcgcggtattcgggccattttgaaatcatgatggattcttcctcgtcctggagcgtgcagaaaatctcttccgtcacgaagggcatgaagggatgcagcagcttcagcgcgttaagaagcacatttttcagcgtccacagggccgctccctggctgtccgcatcgtctgtgtcatacagcctgggcttcaccatttcaatataccagtcgcagaactcatcccagatgaagtcatataccttctggacagcgatgcccagctcgaagttctccatgttgtcggtaacttccttcaccacattgttcagcttggaaagtatccatttatccaccggctgcagatgcctgtccgcatcctgagggatggtcttgccgtccatattcatcatgatgaaacgggaagcattccataccttattggcaaaattacggctggcctccactctctcatagtagaagcgcatatcgtttccgggcgcatttcccgtaatcagggtaaggcgcagcgcatccgcgccgtactggtcgatgatctccagcggatcgatgccgttgcccagggacttggacatcttcctgccctgggaatccctgacaaggccgtggaacaggacggtggaaaagggtttttcacccatctgctcatagccggagaagatcatgcggataacccagaagaaaatgatatcgtagccggtaaccagcacgtccgtaggataaaaataatccagatcctccgttttatccggccagcccagcgtagagaagggccacagcgcggaggagaaccaggtatccagcgtatccggatcctgggtcaggtgggtgcagccgcacttcgggcaaaccgaaggcgcttccttagccaccacgatttcaccgcattcgtcacagtaataagccggtatacggtgtccccaccagagctgtctggaaatacaccagtcgcggatgttatcggtccagttataataggttttgtccatgcgttccggaatcagccggatatcgccgtttttcacgccctccacagcgggcttgatcagctcgtccatttttacgaaccactgctttttaatcagcggctccaccgtggtcttgcagcggtcatgggtgcctacattatgggaatagtcttcgattcccaccaggagtcccatttcgtcaagctccttcacgatggcggctctcgcttcataacgatccatgcccgcgaatttgcctccgttttcattgatggtggcatcatcgttcaaaatattgatttcaggcaggttatggcgctttcctacttcaaagtcgttagggtcatgagccggggtgatcttaaccacgccggtaccgaattccatatccacataggaatccgccacgatggggatttcccggttcatcaggggcagcagcaccttcctgccgatgagggacgtatatctttcatcctcaggattgaccgccacagcagtatcacccagcatggtttccggacgggtggttgcgaactccaggaactccgtagtgctgggcgcgccgttttcatctatgagcgggtatttgatgtgccagaagtggcccgcctgctcctcgtaaaccacctccgcatcggaaatggaggtattgcataccgggcaccagtttacgatacggctgcctttatagatccagcccttttcatgcattttgcagaacacttcggttacggctttattgcagccttcgtccatggtgaagcgctctctgtcccagtcacaggaggagccaagcttacggagctggcttgtgatcctgccgccgtattcctttttccattcccaggcgcgctccaggaatttttcccttcccaggtcgtgcttgtcaatgccttcttcctttaatttttcaatgatcttcacttccgttgcgatgctggcatgatccgttcccggctgccacagcgcattatagccctgcatcctcttaaaacggatcaggatatcctgcatggtattgtccaaggcgtgtcccatatgcagctgtcccgtgatattcgggggcggcattacaatggtaaagggctttttgcttctgtccacctctgcatggaaatatttctttgctatccacttttcataaagtctgtcctcaatgccatgaggatcgtaggttttcgccagttccttactcataattactcctatccgcccgctcctgcgggcctttattttgtgtggggggacgggctttcccgcagtcctgcccggcgtcctggtttcctgcggggtgcgggcggggggtgcgtgttcgctttcaaaaatggggtatttctaaccgtttccttttcccattctgctcccaacatggcgcagaactcctcacccagggcaactttcgctgcaggcagcttcagttgtctgggttcgtcagacagcgccattaggggcgggatcagaatgggaaaaggaagcggtaagaaataactccattttttcaaagctcacaggcactcccccgtccgcaccccgcagggaaccaggacaccgggcaggactgcgggaaagccctagggtagtggccgcggaggttaagggcagaatcgtgtgaatatgccttaaggtacataaaaaagccctctgccgggttagttcggcaaagggcgttgttaacgcggtaccacctttgttcaccgggaaacttggggcgtctggtgtagggaatgagacgctcaggggggcagggggatttttgctgttgcggtaaaaatcctgggttccggcctgcgtttggtttcctggcctttggcatcttttaacggggatgaggcgggaggccttaatgggcagaatttatggggtctgcttttgggggtccgattccaaagctaccttcggcattcctttcttctgaacgtcttccagcctggcttggattttgtatgtcgttgattaatatttaatcagcggggattgcgccaggacgttcttctctgtgaaggggggatgcttactcctctttttcattatctttgatattatggcggctgaaccctgtaatttcggggtggccaatttattttttactataatgaatgaatgggcttttgtcaagtccatacccgtattgttttatgggttatgtgagcgttcttaaaggagtctgggggcgcacatttataaattcggcctgtcggcaggggctcgtactttatattgggcaggagatttctgtaaagttcttcataggtgtcatagattctgttcatcgcgccggtatgttctgccaccaggtattggtggggctggatttctttcagaataaagccatccggtaagctggatttcctgtccaatgactgaaaatgcttccagttcacgtatttcatatttcattttatgcctcttttttccgcaggcaggcctgcaataccgcttccttaagccgttgaacgggctttatatcgtgagcaggcaggataaacgcatcaacgcaggcaacgtccttcccgccgtccgggctgcggctgccggccttcttttttccgggcaggatgggggtgtgggccgagccataagaaaaaacggcggatatttcttactgtcccgggaggccggaattttgccgtccctagcggcctgtctgacgaacgcagcagacgctagtcgctgcgtgaggagttccggccgcgttggcagaattctggtttcccggaacagttagaaataccccgtttttgaaactgactcagaccacacccccatcctgccgggaaaaaagaaggccggcagccgcagcccggacggcgggaaggacgttgcctgcgctgatgcgtttatcctgcctgttcaggccgtttctttcactgcaatccaaatctcgacaaggccgtcctttccatagtattcgatatccggcgctcctgatttcattctgcctgtaaggtagcctttatttaagggccggtatttggatttgggcagccattttgtgattgccatggcttccgtttttccgatggtttccagcgtgcaggggaaaattgcccatgtcatggccggtatggcgtattctgtgatatcgtttcgcgtatctttgtcacttgatactgcgatcagatactcaaatttacggggatctgtttcgtccgtattataaatatttattccgagcaggccctgctgcttttgatttgacagcgcctgtaacggtttgtcaaggttttctgttttaaaccaggtccagagggccgggatggcttttctcccttcgcctctcctgttcgttgtctgaattttgtaacctacggtgcggaagctttcttttttctcaatccgaaaaggtaaatccattgtaaccctcctgtttagctatttgcttttttctttcgggtccgggcagccgccgtggcggaacggatgttttcttcagcggcccctttgcctgtgcatccataattgtactttaaatcaggcggcgcttcctctcttttacagtaccaaatagataagtatccgtcatattcaggctacgggatttactgcggcgccaataaagtcagggcagccgcatttactccgcctgacggtattgttccgccagctccccggtaatgggcatcaaccggccgccttcaatggaatatacctgatcgcacagctgttcaatgtctttatagcggtgggacgtgaggaaaatcgttttgccctccgctttcagcatacggataattgtcctgacatcctcatacgtcttatagtccagggcattaaacggttcatccaggatcaaaatatcctgtccctccataatggcctgtgccagtcccagtttctgtttcatgccaagggaatagtgatcaacctttgtcttatccgatggatcaagccccaccttgtccatggcttctgcaatttcctcttcgcctatcctgccctgaatatcagccaggaatttcaggttctggaaaccgctgtaaatgccgataaaaccgggcgagttaatgaatacccccatattgtccgggaaatcccggccattctttccaagctgcctgccgcgcacatagatgtctcccttatccggtttttcgaagccgcacaatattttgaacagcactgattttccgctgccgttggcgcccacaaagccaaccgtttttccgcgctccacagccaacgatacctcccggagaatcctcctgtgtccgaagctttttgataccttccttaattcaatatatgagctcataacggttcctcctaaaccaatattttcttactgccgaatgtcaagagccacccaagcgtcagcatgataacaatagcctccgtccccagtgccgctgcggcagggagcccggcaccggaatttaattccgcaatccgtgtcaggcctgaaaggccgaagggcagataagatacccattgtccgggcacaacacagagcagatttcccgcagccaaaaccagaaaaccgattgtaacctgtcttgaaacggcataaacacacatcatgacaagatactgtcccatagtatcaaggaatttcataataacagcatacagcagcattttccacgccgtaatcccgtctgcatatccaaagaaaaatattccaaaaagccccgcagcaaaccaaagaagcgcataggcaacgagaaaacctgtgccggcccacagaattccactcagcagcttccttcggctttccgcccggacggaaataaaataggactggccgcttgccgtccattccaggaatgccgccagaagatacagcggcgcaccgtttacaatcagcatttcaaggaatgggaacacccggaaacagcctgtcccatgcccggcaaacagagaatatacccattcctgcccggattgtaaccgaaagcctgccccggccttgtacagcgttattaccaggacaaccgcaaaaagagccagtaacttctgccgcgccgccaattcgcggagataacaggctgtcatgcctgatatccgcggccgcgggagggatatacgcccccgccatccaaaccgcaccgttacagtaatgatgatggcaaacagcaataatgtaattcctgtgacagcaaaacggtgatgcgtccccaaattatggtgcagtatcagcaaatgattaaagcccgtcagcggcaggctgcggacagccggaatcttcatccacagaaccgagagaatgtaaagggcaagaatcaccctgactgaccatttccgccccccgaaatgcccaatccacatgcaaaacccgattatcatccagcctccgaaaaactgacaggcagagaatgccgcaaatgcctggaccggggtggaaaaatactgccgcagcacaaaaaacagctctgcacccgccgctccttcgggtaattcccacccatttcccccgggaagccccatgccggataaaagaaccgccgcgctttggacagcgatcagcaaaaggacaatcccccctgttcccagccattttctataaaaataggaatgatagctttgaaaacgcaaaatcacattttccccgtcatcctccaaaaaggaaaaacagcttaacagtaaaaccggaagcaaaaaacaggtcaaataatagtgatcggataccgccgataaaatatgctgttcaaaataaatcccttcgtttaaccggccgctgacggaaaagagcaggcatccggcaaacaacacaaacaccttcccatatccccacaggcggaaattctttttgctaagcgccgccataacaagccccctaaacgttcaccacagtatttttcctgatttttgcaaggaaaaacgctgtaaaaccgatgacacaaagcagcagaaccggtcccgtgaaaaacgaaagccacgtcaccgcatggaaactgatacacgttgggtcaaaagcgacaactaaccggtatttctccaaactcagaattgccataataaaattctcaagtatggaatagataaacggcccggtgagtattacaaaaatatttttacaatacatggcgagtacaaaaccaaaggtcatggctaaaatacctatcacacctctccagcaggaaaaagcagccgcataaagcaaaggcttttctacaaatgctgtttggaaaacatgcgaaaaggtattggtttcaggcggaaccaccggcgctttaatatcaatggcatatactgcagacaacagataagggaccgccataatgcaaaatgctcccagtgcataggctgtccattttgccgtcaggtattttttaaccgggacgcgcggggcgatatacaggagaaaattatttttacgctcataatacagattccagcagagcggaatcacaacaaacagcggataaagcagggaaaaccctcctgttcccacctcccacgcctccaaatcataatgcagtgtatagcttaaatagagcttttcaatcagcacacacatgataattgtcaaagcggcagttgttaaaagcaccggcagaaacatttttttacattcgttttttatcaattggggcatatcttccattcctttccgtttttcataactgttcaatttccttcacagttactctttttcttcaatatatcggagtatcctgcgcacttcaacctcccggaaccaaacgagggttttaagggaacaaaataattttcattcctttaaaaccctcgttcatacccgttaattatggaagaaggacgccaaatacaacataattttcttccgaaacggcttcgttgcgcgtaacaatctttccatgataccgttcagtaatacgcagtatgttatacaagccgtagccgcgcccctcactgctgctttttgttgtaaaccctttcctgaacagccccatgaactccgtattcgacatggccggggccggattggaaacaagcagctccagatacgtcccttttttcctgacggcaatataaaccgtgcttcctttcggggaggcctcgattgcattatccagcaaaatcccgattgcttcaatccactctgtttccggtaccgcagactttttaaaaagcccatgcagctgcaattccatatgaatccccgccgcctccgcctgttttatttttccaaacaacattcctgcaatgaccttgctgtcacaggagagcaattcccggtcgttggaattaatgacaatgccgcctgtcagcgccgccacctctctttgcgcctcctccaaagtgccggcagaagccacggccgcctcaattgccagcatacggttctgaaattcatgctgccttgccctcacctgggaaatcagctcctccacaatgggcacatactgttcaatcatatggattcgcttttgctcctgcagcctgcgccgatgaaaaaacagcaggatgctgttaaacaaaaggaccgccagcaccagtaccgtaagaagccctgaataagaaaggaacctctccgcctggaaagaaactacagtaagctccaccatcagcaaaaccgcaatatccgacgacacaatccagaccgcaatccctcccgtcagcaccaactgctggagcacgccataaaacggcgtacaaaacagcaatgaaacaaggagcagcgtcaatacacggccgccaaaaagcagccagcctccccaagccccgaaagcggccaatacagcgacacaaacacacctgacaagcagatacaacgaaaacaccgccattgtcccactaagaacgtcaccgttattttcccatttgaaataaatactgtgaagcagcagcacagaaaaaaccagaaacagccatcccgcaatactgttaaccggcacaatctcatatccgtatgcggaaagcgcggcgcgcaccccttcattcgctacaaaattcacccgcgggacaacacacaaaacaagcaaaacaggaaaaagcagaatatccttcccccttgcctccgaccttttctgaaaaacaccttcacagcaaactgccaatgcgcccgcatccagccctgactgcgccaaaatacacaaaacattcatgcttccccccacagcccggcctgatacttattgcccacaggcaccacctccgtaaacccctttaaataaattttccgcccggccttatcaatcctgtcaatataatccctattcacaatataactcttatgacactgtacaaaaggaccgccctccagcagcgccagcattccggctaacgtatacccggaaacagtatcctcttttctcccggacaaacggttatccgtatgaataaccagtttcttcccaaaggcctcaatatacacaatatcctccgccgcatactccagaataaactgcttttgctcaagctggattctactccgctcccgcctgatctgcccggaaagtcccaacgcatcgcgaaacgcctcagcaaattccttctccccaaacggttttacaaggaaactgtaacacttcacgtcacgataagccgaaagctcctcccccgccagccccgtttcaaatataatcggcgtatacctatactccggcagcccgcgcaattgcttcgccaaatcagtccccttataatcctccaactgaatatcaataataaaaagcgcaatctcattctcccttgcataccgcagcgcctcccccgccccggcaaaagaaatcacttccagctctcctgatattttcccaatatactcaacaatccgccttaccgcgccccgattgtcctccgccaataagattttacctttacccatcattatgccacctcatcctgcgcctgtttttcagccatattttcaatcctgttaccttccagcatattataattcttccacacagacaatacaactttcaaagaaaaaggcctgcctgcccaacagttacaattatttgtatccgcttctttacaaaacttacatatagcgttattatatatctattagatatatttaaatggaggatttatgttagaatctattattttaggcatggtatcagacaatgatttcaccggctacgacatcaaaaagctgatagaaaacggcatcggagttttttataaagcgagctatggaagcctgtatccggccttaaaacgattaacagacaaaggctgcttaacaacctacgaaaaaccccagggcggcaggaaaaaaattttctaccacatcacagaagagggacaaaaacagtttttcgactggctggtttcacccactgatataaccgaaggcaagaatacccatctggcaaaaatttatttctttgataacctgtcccccgaaatccgtgagcaacagctattggaatatgaaattaacaacagaaattatctgagaaaactgaatgatttagaaaataagtataataaaatggaaaacaaagaatgtttttactataagctatcaaccctttactacggcatctgcattacccaaaaaacaattcaatggtgccagcacatccgcatgcaaaaaccactctccgacttaatacaggataaaaaatcataaaccagcgaaaggatgactttatcaacaaccaaaggtaaaaattatgataacaaaatcccccagcggcgccctcagcccatactactacaaaggcggctacttccatggaattcattatggcagctactttaacgattcagacgcattactttccatgatgaaaaaagaagaagagttcattctaaaatcaccggaaagacgcagaatcctaattgatctctaccaaacgactctaaccaaagcattaacagaaaaaattacagaacatatcaaccgcctgcgccccaacatcataaaactggcaatcaccgccacccccaaaaaccttcacaaactccacaaagcccttaccagaaaaacctcactcccacaatcacaactatatttttccaccgacatggaagaagccaaaacatggcttgtaagcgacacatgccatacgcacatctattcaaaataaatattgccacttccaaattccagaatatcagctaaaatgataacacactactctaccctaattttgttatcacgcaccactgttctatcctatccaaagtattcaatactccaacacatttatatattttcactactattcctctttatctacctgtttgccaaggccaggagaaccgcatccgccccagtcccttccctttcgttggggcggcgggggcctgtttttcttcttccggacggttgtggggtatttccggcaccataggaaaaaacgatgatgtttcttactgctcctgcctgccagaattttgccgcccttagcagccgcaagcgactaaagtcgctggacgaacacagccgactgaaagtcgctgtgtgaggagttttggctgcgttggcaaaattatggcaggaacagttagaaacaccatcgtttttgaggctggtgccgaaaataccccacaactgcccggaagaagaaaacaggcccccgccgccccaacgaaagagcgaagggactggggcggatgcggttctccgtcccccctagcgtgcactgaaatttttcatttgtttatagagttcccccgccgaaaccggcttgctgatatgcgcattcattcccgccctgcggcttttctccacatcctccgcaaaggcattggcagtcattgcaaaaacaggaaccgtcccggcgtcactgcggtccagagatctgattttcttcgtggcctcgtaaccatccatttccggcatgagaatatccatcagaatataatcatagaagccctccggggaagcggcaaatttctccacggcaatttttccgttctcagccatatctgtccatgcgccggcagcctgaactatttcagcggtaatttcccggttcagttcgttatcttccacgatcaggacgcgtttacctgcaaactgcttctgttccaggcagatttcttcgttttcttcattttcaggctgtccgccacaatcggctgaatccgcttcgccggccccgtcggcttcgggaaaaggaatatccagaagaaataaactgcctctgccaggctcacttctgacggctatgctgccgcccatcagctcaacgaagcgcctggtaatcgcaaggccaaggcctgtcccgccatacttgcgggccacattgctgccctcctgctcaaaggggctgaaaattttatccaggttttccggcgcgatgccgcagccggtatcctccacttcaaaatgcagccagtgtctgccgtcctgcactttttcttcccggatccggaaccagacctgtccgcccgcttccgtgaatttaaaggcattggaaaaaagattgctgataatctggctgatacgcagcgaatcacccagcacaacaaggctgtcgtcaacggatgactccacatgaaatgcgatattcttatccgcggcctgggaggaagctatgaccatcatctgctccagtatcattttcatgcttattttttccgggcacagctcaattttgccgctttccacctttgacatatccagcacgtcattgagcagggcaagaagatgcctggaagacatgtcgatcttattcaggcagtcggatacccgctccggatcctccagatgatgcatggcgatatggttcatcccaataatgccattaagcggcgtgcgaatttcatgggacatacgggagaggaattcacttttcgccatgctggcgctttctgccagcttcagagcctgttccgttgattctttttcccgggccaggagacggttcttctgccagatgaccatggaatacagaagcgctatcccaagaatacttaccgcagtgagcagtataaccgtcatggcaacccttgtcatgctgctgctcagttcccctatcctctcatccagcttaccataaggcatactcacgcagatgtaccagtcattgacggacagcggtatataataaagatatttatggataccctccagcgtaaatgcagtgacgcctgttccgccctgtcccacattgtcccgcagcatcgaagaagcatatccttcatcaaattccgcctgttcctccaggtaatcgaacaggttcctgcccactgcaccatcatccccgtcatgtctgatgatataattcccgtttgtgtcaataatgtttccataagcgttggcgccttctctgtaaagcgacagcctttcccccagatacgaaggagtcattcccaccactgccgcaatcagacggtgctcaccaaacatgacagaaggaatttccgaggacagcaaaatcatcgtatttccagtgagcacactgtttacctcaagatatttatcctgtccttcaagcaacgcctttgcgccttctatacgtccatctgcagaaaaatgcccttccgacgtataataatccccattatcctccagaaaagctacaaaggcataagcgttcttcacagtcctgtcccggataaaagcctgaagcatttccatgctttccagatccgcctccgttatgttcgccgtaatgctgctgacccggataaactggctgttcattgtagtatcaaaatgtcccgccatctgatctgccatctccgccagataaatgtcgctgatatccagaatcgttcgccttgtttcctgtctgtccgcccgtaccatccagaccagaagcgaaaaaatgagcagtcccaacactgccgccgctgccatcacactggtctgctttttattcgaaaatgaaaacttgccttccttcattaccggttccgcctgattatattttatcgtccagccgtaaagctttattttttatcatcatagcatcccgaagaatgaaaaacaagactttattacagtgttttcggatccggtttttccgggttatatattacggttcagcctggtctgaaccgccgcttcccagacctgcccggactgtaacggttatgttccaatgtccccggtaatcctgtattttcccggcggcagtccctttttctgccggaatatattggcaaaatagtgctcatccgaaaactgcagccggtaagcaacctccttcaccgtcattcccgtgtttctcaaaagcaggcaggccgtgtctattttccgggacagcacatattcatagggtgtctggccatatgccttccggaaaacccgtgtcagctgggaaggggaaaggctggcttcctttgccagctgttcaatactcaggcgttcataaatatgctcatccacatatttcctaactgcaaccgcagtctccggaagccgtatttccggctccgctcccgccgccgcatgggcggccagctgaagaaggatttcatggaaaaggagggaggtcctgcgggccacctcggttccgctgccctcctttttttcacagacatgaaggaactcccggaataaaggatagaccgggcagtcccggaaaagaaccgtctcccccagaccgaagccttccaccagggtgtcgcacaggcttccttttacattcatccatatttttttccatggattggccgcatcggcctggtaaaaatggctttttccccggggaagcagataaacgtcccccttggccggacggtaggtttcctccccgatcctaagcaggccttccccttccataatatactcaaggatatagatggaggaattctccctttctatatgataatggctgtcaggataggtaattcccgtcatctcaatctgaaaaaccggctctcccgggagctggcccgggaggaatgtaatgatttgttccataatgcgtgttttcctcaatattttgcgtgtaatttccatttattaacctatattatagctgtatacttcaagtaacgcaagatgagccggggcatccggcagaatggaggaaattatggggaatatacctagaccggaacatccttttccgcagtttgtacgcgaggactgggtgaacctgaacggaacatgggattttgaacttgatttgaacaacagcgggctggaaagaggctttggaaaaaggacggattttaaggacaagatcctggtgcccttctgccctgaaagtgaattgagcggcgttggctacacggactttatcgcagccgtatggtatcaccgcaccgttaccgtcagcgcagagcagctgcagggaaaggtttacctgcatttcggcgccgtggattacgactgccgtgtatttgttaatggcacggaggcgggaaggcacaagggaggctatgtgtcctttgccctggaaatttccgcgcttctgaaggaaggggagaatcatctggtcgtatgtgcacaggatgataccagaagccctatgcagcccatcggcaagcaaagcgaccgcttctattcacatgactgctcctataccagaaccacaggtatctggcagaccgtatggatggaattcacacctgccgcacatatctgcagcgtccagtattatccgaatgtagcggaaggctccgtaaccatcaaggcagtagtggaaggggaaggcatcttcagcgccgccgcttcctatgagggaaccgcctgcggaagcgcatccgccaggacggattccggcaacgtaatcgtcaccatccccctgagcgaaatccatctctgggaagcaggggcaggacgcctttatgatctgcagctttccttcggcgatgacaaggtgagcagctacttcggcctccgtgaagtgaagctggacggctaccgcttcctgattaacggcaagtccgtattccagcgtctgatcctggatcagggattctatcccgacggcatttatacggcgccctccgacgaggctctggtaaatgatatccgcctttcgatggcggcaggcttcaacggagccaggctgcaccagaaggtatttgaaccccgcttcctctatcactgcgacaggctgggttatctggcctggggcgaaatggcaaactggggctttgatcattcctcctattccggctatgaggcatttatcccggaatggatccagtcgattgaaagagatttcaaccatcccgccatcgtaggctggtgtcctttcaatgaaacctgggattttgagggacgcagacagattgacagccttcttgccctcacatggaagatcaccaagcagtatgacaccacccgtccctgcatcgataccagcggcaactaccacgttgttacggatatctttgacgtgcatgactatgagcaggatcccgaagcatttgccgccacttatgagccgtttaaaaatggtacgggcgtattccacgaccgtctgggcgacaggcagcagtacaaagaagggcaggcgatgttcgtcagcgaatacggcggaatcaaatgggctcccggcagtacggacgaaaaggcctggggatatggaaatggccccaggaccgaggaagagtacatatccagatataaaggacttactgatgcgcttcttgacaatcccaggatgttcggcttctgctatacacagctgacagacgtggaacaggaacagaacggcatctattactatgacaggacacctaagatcgatgtgaatatctttaaggaaattaacagccggaaggctgctatcgaagactgatacgaatagatgccctggcttaatatcatgacatttatctcccacagctgcggaccaaccccttacatatcctatgtgttccgcagctacgggaataaattaagcccgaaaggaaaatggcagttacccatgaagtatgtatgccatctgcctttcgggcctgttattcttattttgaagcacagacataactgcctggcaaagctataccctgccttccataataatattctgaggattcattcccagcgctttataaaagcccatggccgattcattaaaggcccataccttcagctccaccctgttgattcccatcggcctgattatgtccgccaacgcctcatagagcgcttttcccacacccatatgcctgaaatcttcaaggatacagatatcgtcaatgtaggcatagcgtctgggcaccaccaccgggtgggccggagcctgcttcagcttgacattacatatgccagcagccctgccgtctgcctcggctaccaggaagaaggaattttcctcctccatcagcttttcaaaatcttccctgccaaacgggctgtcctccaggtcggcaaaaatatccggccggtttaccgcatggatatgttgttcttcccgtatggccgctctcaacagctcataatctccccagccgccttttcttacggtaattttctttttctcctgcatcaaatttacctcttcacttatatgccttctataccaaatctgctgcgttttctccgattttgctgataatctttttattaattctcgcatagaagaacagggtgacagccagcgacataagttccgcaatcgggaatgcccaccatacgttttccaccttaccggtcagggaaagcagataggctgcgggaagcagcactaaaagctgtcttgccacagataccgccagactgtaaacaccgttgcccaaagcctggaatacactgccgataacaatacagaagccggcaaacataaagctcaggctgatgattctaagggcaggcacgccgattgtcagcatattttccgaagcgttgaacatagccagcagcttgtccgggaaaatctggaaaacaaggagccccaccatcatgatggacaccgcataaatgatactcagctttgccacatgcttcacacgtttccggttgcccgcgccgtaattataggccacaatgggaaccatgccgttattcaggccgaataccggcatgaacacaaaactctgcaccttgaaataaacgccgaagaccgccgtggcagttgaagtaaactgaatcagaatcaggttcatgccataggtcatgacagagccgattgcctgcatgataatagacgggatgcctacggcataaatcctgccgatcatttttttctcaggacggaattttctgaaattcagatggatatccttgttcaccttcaggttaaagataattgccagccctgccgcaacaatctgtccgaataccgtagccgccgctgcgcccgcaacacccattttgggaaagccaaagaggccgaaaatcaaaatagggtcgaaaataatattaatcactgcgcccagactctgggtaatcatggtatacatggtccgtccggtagactgcaacagcttttcaaaggtcatctgggtaaacataccgatagaacagatacatacaatcgtcagataggttacgccataggatacgatttcctgatcctttgtctggcttaaataaaacggcttcgcaatcagtacgccgactatcagaaataccacgtaggacataatcgcaaggaaaacgccgttttccgccgctttattaacattctcctgatcccgctctcccaggcttctggaaaggaccgcattgacgccgacgccggttcccgtgctgagggcgatcatcagcgactggatagggaacgccagggaaacagcggtcagtgcattttcattgatcatggatacgaacacactgtccacaatgttgtaaagggcctgcaccagcatggaaaccatcatgggaagggccatggacagaagaagcctgttcatgggcatggttcccatcttattagtcataacgcgttccggctgctttccctctcccgccgcctgggacaccgcgccatttacagctgcatttttcttttgtttttcactcattttaacaccactttctaactcttaactagctaaccattccagtataatagaaaaaacagcagcccgcaagtaaaacaaactgctgttccttcctatttatataagcaatttaactaaagtttttgcaaaactgtcctgtgccatcacagttacttgcaaaattccattcaaaaccacctgcgaaattaatattttgtacttccggatgactttcagccggtcagcactgtaaacgcaccggccggctgaactgctgatttttccttatgcatggggaatattggtaaattccgatatttcccggctgatggtgcataaatcctcaacgcttaaatcatgcagtctctcatgccctgtgatacgggcaaaggttttcagttcctccagggagcagttgagatagtttgccactctcgctgccgccgcatccatcttaaggcgtgctctcagtgtctcatcctgtgtggcgattcctaccggacatttgccgctgccgcaaatccggtactgttggcaggccgctgccatcagcgccgccgaagccaccgccaccgcgtcagctcccatggcaatcgcctttgcaaaatccgaggatacccgcagccctcccgtaatcaccagggaaatatcggatttcacgctgtccagatatttccttgcccggtaaagtgcaaatacagtgggaacacttgtggaatcacgcaccagacgcgggctggcccctgttgcgccgcctcttccgtcgatagtaataaaatccggaccggcaaagacacagtattccagatcccgttcaattcttcccgctgcgatcttgatcccgatcggcctgccgtccgattcacagcgcagtttatcaaccagcgcccgcaaatcctctctggtattgattcccgagaatctggacgggctgataacgtcctgtcccagaggcttattacgtatggctgcgatttccggagtcaccttgcctcccggaagatgtcctcccatgccgggcttggtaccctggccgatcttgatctctatggcatcagcgcgccgcaggttctccggcgtcacactgtacagattgggcacatattcaaaaatatatttggccgccgcttccctttcctccggcagaatcccgccttcgccgctgcacatggccgaatgcgccagagcgcttcctctcgccagggatatcttggcttcctttgaaagcgcgccgaaggacatgtgagatatgtataccggattgtccagtataagcggcttcttggcattcgggccgataacggtggtcgtatccacatgggcatgctcatccagcggcggcggattcagctgtgcccccagaataagtatgtcatcccagcagggcatgggcatctgtgtccccatggcctcaataaggggctttcctgaaaccgccatttcgtgaatctgagccatgtaccggatattttcatcctgccttctccatttctccggataggcaagagtctggggggcactattttcatctgtgcatgcagcgccggccggcgcttccgtttccccggcagctttcaggcctgtctgcgtgccagcttctgcagtttccgtttccggcacagccgcaggctgctcctccagcaaacgtaagttatccggggaatacccgcacaccggacatttttccagctctgaaaagagcttcccttccttttcctcgtcaaaaatgtaaccacagattccacattggtatcttgccataccttttacccccttattatttataatacggccgcctgcttccggcaaagccgttcgttcccttttttacacctgtccctggctttattcctttctgttttttacctgatcccttacctccttcagcccctgatccttgttttccagcggataaatccacatatggctgtccgggttctgtacatcctgacaaatcggcaccctgccttccagatcccttccttcaaaggtcttaaacacaccttccttcgcttcaccgcgccattcctgcacgttgccgtcggcattcagcgtgttgatatacatatttccatggtacagcccgtccttgaaattgccgatcacattctgaaaataacggctctccggggctgccctgttgatatccagatcatagtgctcctggccttccccgttgggcagattgtccagccaggcaccctcatagctatgggtaaccagaaccggatcaaaggaagcggcggcattgtcctgacagtacattttcagccacattcccttcccgctgcgcaggccgtccttccattctccgtagtaatactgatcctctccgtaaacggcaatgcccgttccctccgggctgccctgctcattcctgtccccgtagtaataaaaataagctgaacttttcagggaggccgacatggcgcggtaatgcgccagcccgctcagatcctctacggcttccacattatccttctgccagtaatccatcatttctgcgagcatctgggtattcgttttctttacaatgaccgtcgccgtatttgcgcttacctgcgccgtgcccggcacattggagccggatacggcgggaggcgcgtccttcacagcatccggcgcgctttccgtttccacaggttcctcggcatccagctcaatcgtctcctgaacctccacaggatcctctttgccggtattttctcccgtttcacctgaggcttcctccgtgctttccgccgtttcgccgccgctttccgtttcgctttccgtttcctgcaccgcctctgtatccggccccgtaccggactgcccctttttctgcctggcactgactgcgcacattaccaacactacaatgataaaaagaagcagggcggctatgggaaccagctccttcattaatttactgtttttcattcctattctctccggttctttcttttcagggcggcagttgccgcagccttcgtttataactgcccatcacttcagcagttacttttattctaccatacttgaccgcaacgtcacagaaaagattttcttaattaattgggcttcattgcctgcgtctgacatatacctctgcccacgccgggaaaaagccggcgtttatggcaacgctcctggaaagcccgtgggattccgcggtgccgtagaaggggattttccctctggcaaggatctcctgtttcagcagggcaaccagactggaggccaggccacggcccgcaaattcgggcagcacgtcaattccaatctgccacatcagcggactgtcctcactggccccggccacagcagccacttttccgtcaataatcgcagcaacagccagcatatccggcatcagctcagaaccgcagatggcatggcggaactgccgtccctccttccagtcgggcagctccccttcttccagccatctgacctcaaaatccggttttaccgccgtttcctgcattccagggagaaaataaatatgggtatccgcaatctccctgcgctggctgcgaaggcagtcatccagcctgcgcaggtttgaaaaacggcagaaccattccggctccggtccctgttccccgtattcacggcagcaccagtcataaattgcctcatccgccataagataccctttcccgcagaacagaatcgccctgaaaaacagatccatcccttcatatacccttgccctggaatcaattccatagtcaatgcctgccgccgctttttccatacgctctctcataagccagccataggccgtatcagtcataaaggtctgatccggcattttcggccttcttcctattaaataaccgcgttttcctgcttcgccggacggatccagcgcgcagtccattttaaactgggcctccaccttttttataatatcctcagctatatgcatttttgttaatcctccctgcagattgtgctgctgccgcaaatgcgcttacctgccctgcggctgccggttttttcatattacaattacgtatttcttctgtcaaccggcgctgcccgattttctcgttctgtatttcgtagttccgtgatcggtataattattttttctttccaaattatgaattcttcgccgcttctcttgacagtcaccatatcgctgactagaatgtaacaagaatcatggggtattctgatccgtatgggaaaacaaggcttccaagccgaagctaaacggcacatgcggctctgacaatattgattttcaaatgcgctaatgcgcatagatgggagtaagctgaaagaaggacgctttcagccttcctgattttcaaatgcgccaatgcgcatagatgggagtaaaaatgaaatttctaaagaaaataaaggaaagcaggctgaacctgattttgctgctgctttacccaattgtaaccttttatctgctggaatggtttacccataatccctggaaaaccatgaaggcaactccgcaggtgctcaatatcgtaatgtttgagctggttgccctgctgcttttcgccctgttcggccggctgcatgcggcgctgatgacggaaacgcttttctttttcctgtatgggctggtgaattatttcgtgctgaatttccgttccgtgccgattcagccctgggatctgttctccatcagcaccgccgcaagcgttgcggacaactatgaatatacgctggacaaacaggcgcttcttgtggttatcggctttctggttctgctgatactggaatttttctgcaggtatactctgaaaaaaggaacctggaaattccgcatacccacggctgccgttgtatgcgccctgctggtggccttcggcggtatgttccattccgacgaaatcgtccagcagaagctgcggctgtatgacaagctttttaccccgaccaccatcagcttcaagaacggcacggcgctggcctttgtcatggagctgcgttatatctccgtagacaaaccggccggctacaacgcggatgctgcccgggaggagctggccgcctatgcacagccttcggaggaaccggagaaaaaaccgaacattatcgtcatcatggacgaagccttttccgatccggccgtgcttgcggattttcagaccaatgaagattatatgccttttatgcacagcatgatggacggcgcggacaacacggtttccggatggctgaatgtttcagtcctggggggaaatactgcaaataccgagtttgaatacctgacggggaataccatggcctttcttcccaccggcagcatcccctaccagcagtacatcaaggcagaaacgccttccatggcctcccacctggcttcccttggctataaaacggtagccatgcacccttacaaggcaaccggctgggaccgggataaggtttatccggacctgggctttcaggaaatgcatttcctgcccgattataaaaatccgcttcttgtgagagagtatgtaagtgataaatcggattttgagaaaattattgaaacctacgaaaagaaagaacccggagaaccgctgttcgtattcaacgtaacgatgcagaaccattcttcttatacggaaagcttcgataatttccagccggatattaccgtggagggcgccaattccacagccctgaacaattatttatccctgatgaagctttcggacgaggcgctgcaggagctgattgcctattttgaagggcaggaggaagaaaccatcattgttttcttcggtgatcatcagcctaccaactccgttgtggagccggtatggaagctcaatgggaagcgtaatgcaacgttgactgaggaagaactgtcacggcgttacaaggttcctttcatcatctgggccaattatgatattgaggaaaccacaggcgtggaaaccagcgccaattatctgggctttcagacgcttcaggccgcaggccttccccttcccgattatttcagctacctggccgctttttccggggaggcgcccgtaatctccgccaaccatgtggagcttaaagacggtacctttacgaatgcggacgatcagaaggatttgctttccggctacagaggctatcagtattaccagatctttgatgcatcaaagcgtaacggcggttaatttcccacgccggaaaaaccgcacggccacataagcgtaacccaattacagctccggaggtacaacgacaaaaatgaaattcatgaatacaatgacggcgggccgtgcggcccgcaacaacccatccaaaacggcagcctcagaacctccttcccctggcagatggataagaagcaactgggcctgcctgctttcctttgccattccttttctgatcatgctgacgattttcattatcaacggcattttcccgtttggcgatgaaagcttcatgcactcggacatgtaccaccagtacgtcccctttctttctgaaatgctcagtaaaatccgaagcggggacagcctttcctattcctggaatgtgggcgtgggctctaattttcttgcgctttacgcctattatatggcaagtcccttcaactggcttgtggcacttttcccggataaatacctgatcgagttcatgtcctatctggtcatcctgaaaatcggcttcagcggttttaccttttcctggtatcttacccggcattttaaaaccagaagcgcggccgtggttccctttgccgttttttatgccatgtccggctatctggcggcctataactggaacgtgatgtggctggattgtattttcctgttccccctgatagccctggggcttgaaaagctggtgactgaagggaaatacaggctgtactgcatcagccttgcgctgtgcatcctgtccaattactatatttccatcatggtatgtattttcctggtgctgtatttcctagtgctgctggtgtcccactgcagctcccttcgccggatgggcggcgctgtactgcgttttgcgcttttttccgtattggcgggaggcatggcggccatactgttaataccggaatattcagcgctgcatctgacgaaattcagcgactttaactttccctccaagctgaccttctatttctccaccatcgacatgctggcgaggcactgcatggatgtggcggtggaaacagggctggatcactggccgaacatttactgcggcgttgcggttttcctgctggttccgctgtatgtttccaatgcaaaaatttccctccgggaaaaggctgcaagactgggcctcctggcgtttctgctggtgagcttttccaccaatgtgctgaatttcatgtggcatggcatgaactacccggattcccttccctgccgccagtcctttatgtatatattcctgctgctcaccctgtgctgcgaggcggtgctgcgcatccgggagtgttccttcaagtccctgggcgtcagcttctgcctgtccctgggctttgtgctgctgtgtgaaaagctgctgaaggacgatgaagcatttgccgtggaaaccttcctgctgaccgccgtatttttatgtctgtatggaatttttgcttattattataaaaagaagaacttcaacctgaagctgctggccgtcctcaccctggttgtggtgaccgcggaagcctccatcaatatgtatcagacaagcgtttccgtgaccagcaggagcaaatatctggaaaaccatgataattaccagcttctggtggatcgcatcagggaacaggacccggatttctatcggtttgaaaagttcagccgggtgacgaaaaacgacggcaccatgataggctatcccaccgcttccctgttttcttccacggccaacgggcaggtagaggagttctacgaaaaactggggatgagccacagcaaggtattttactgctttgacggcgcaacgccgttaacctcctcgctgctctccgtccgttacatgttctccaaatcctccaaggaggatccgaacctgtatacgctcattgacagcgaaggggatatttatctgtatgaatgtaaatatacgcttcctctgggatttatggtaagtgagcatccgggctttgatatcaccgatccgccggacgcgcctgctgacggagcttcctcctccggagcggccgggacggaggaagggacagaaaatccggacgccctggatgaatttctcggcaatgtggaggatacacagacggatgtgctggaagccgtcctggacagagaaggctccaatccattggaaacacagaacctgatggtacgcgccctcggtctgcaaagctccctgtttgaaagcgtgccctcccaggaggaaggaaacggaaccatcgtcacggcgcagcagagcggccattattacgcttatgtgggaaattccaaggtggataccctgaaaatggaatctgaatcgctgtccaagtcctttaccaagctgaaataccattacatctgcgacctgggctggcatgatgaaggggacgtaatctccctgcattccgaagacagcagttccctcagcctttctgcgtaccggctggatgaagatatcctggcgcaggctattgatatcctgggcagtgaaaccatgacagtggattcctttgattccacccatatccggggacatatccaggtttccaaagccggtgaactggtgctgagcgtgccttatgaaccgggctggaaggtacttgtggacggtgaagaggtacagccgggactgtttgacgataccttcatcagcctttccctggaggccggtgagcatacggttgaaatgcattattatcctgcggggctgacgctgggcatcgtgataaccctgatctgcctggccgcttttgttttgattctaatcctggaaaaacgaattttccgcaatggatacggaaatagtaagaagctgacaacagcagaagggagcaatgactgattcatggaaaatacccgtccccgttattctttactggatatgacaagagggattactctgctcagcatgattgcctatcatgcggcctatgatctgacatatctttaccatgtcagaatgccctggttccgggacgacccgggccagatatggcagcagagcatctgctggactttcattttcctctccggcatgtgcttctgtctgggacggcgtccggtaaagaggggactgcttctgaccggctgcgggatcattatcacgctggctacggcttttgtgatgcccgacgccattgtaattatgggaatcctcagctttttcgggctggccacgctgattacggccctgctgaatccgctgctttcacggattccggcttttgccgggcttcccgtaagcttcctgctgtttctgcttacaaaggaagccccctacggctatctggggtttgaaagcttccgccttctggagcttccccgttttctatatcatggaaaaatcatgatggtgctgggcttcccttacgatggattttattctaccgattattttccgctgataccctggattttcctgtttttcagcggctattttacctggcagctgattctgtgggcggcgcttctgcgtcaaaaggccgctgagcggtatgcttttttgcggaacgcttccgcgggccgcggcattcccgcctcttctgtacgcctgccgcttctggagaagccgaaatgccagccgctggagttcctggggaaaaatacgcttccggtttatatgctgcatcagccggtgcttatggcaatatttacgctgattgatctgattggcgtcctgtaggcggccggaattttactttgtccggaacaggaagggctgtttcagttttccttcagatattgcagcagcggcttcaggtactcctttgaagatatatcataggaggcgctgacggcgcggtatgcttcgctgtcctccccttcttttttcttcataagactgcggaacatggccatcatggcccggtcaacggctcccattttttcataattcaggccggaaggaagataaaacactttcagcttctgccattcttcctctgaaaaattctgtttcagcgccttttccggctccggcgattccggcggcatagcccctgtggcaaataccgcaagcctttttcccgacagctccgtcattttcttcctgaaccatttgattccattgatggcgcccgcatggacgccgccgccatatactatggtatcatacgccgtaaaatccgccgtatctctgcggctgtagggcagaagctcacagtttgtctcttctctgacccactgagcgtatttttccgtaaaacccgttttcgtgtaatagatgatcagaattttattcattgtttttcctccttatttctgccagaaaggcatcgcaggctgtttccagctgcgtcataagctcttcctccggaatgtgggagcaagaggtcgccagaattgacgcgattcccattgtgtagattatcatatgcagatgcagctgttccgcctgcgccatggtaagctgcagcgtatcggatataaattttgcaacctcgcggctgctttctttggaatacagatcctgcagggaatggatgtcactgcggcgtctgagaaaatacagctgaaacagctgaggctcctctctggcaaaacgcagctgcgcccggcccatgctcctgaaataatcttttttttcgatatgagccgccagatattccttcataaatgtgcccgtgcgttctgtcagggccgccttcagcccttccatattggaacaatagctgtaaatcggctgtacggaacagcccagcttatccgcaatattcttaacgattaccttttccatcccctcccggcgcgcgatatcgaaagcggcttctattaccatttcccgggtaattttctgttttggcatttttcctcctgtccctattcatgcaaaataatacaaatacgatgttttatatagatatggtttacaatatataactattttatataaatagtttatataactaatttatattctttgcccggttctgtcaactgctaatttattacagtttctgcgggagttaatgtgggaagttgaaaaacgccttttttgtaccgcaactggggaatatatgcgggaagctacaatcacaatatttattcttcttttccatcttattcttccgggagcctcggacggcgggaaggacgtcgcctacgctgatgcgtttatcctgcccttttacccttcttttacatttgaaaatgtcactgcgcaatgctataataaatctcaggacagacaccagaaagcttgcttttttctccttcttttcccatatttgtccatggcctctgtctttttttgtccggttgaacaaatggcgcgtttttccggatctgttactctatttttgcgtgctgcgcagcgcgcggattggttataacacagcatgaaaaaagcgacacttcaggaaatcgcctcttctctgggcgtttcacgtactacagtctggaaggtattcagcggccaggagggtgtatccggcaatctcagagaaaaaatactcgccaaagccagagaactcgattataaatttccggaagagcttgaccggaacgcagtccccgaaaaaaaggacgtcaacattgcggtagcggtctgccgtccggagacttccattttctggatgaacattatccaccagatcgcaaaggaattctcctttcacgatgtcaatctggtttatacctatcttccttcggttatcgaggaggattatacgcttccctcccagctgcttggaggaagcatacacggtatcattgtcatgaatgtttacaatgagcggctgatacgtctgctgtcccgggctgatacgcccaaggtttttctggatacggccacagccattgacccatcctccttaaacggggatctcctgctgatggaaagcggcgtcagcaccgcccggataacggagcacctgataaagcagggccggaaaacctttggttttatcggggacatcaactatgccaaatccaactatgaacggtatgaaggctttaccaaaacactggaacgttttgggctggctttgtcaaaggaatgtatgctcaccggatccatcggcgcttttacctataaagaggaaattgatgccttccttgatacgcttcctgcaatgcctgaggcttttgtgtgcgtcagcgactatgtggcctgcatcctgatgcagctgcttttaaaacggggcttcaggattcctgaggacgtggctgtttccggttttgacgggaatatggaaagcccgctggcggaggaactgaccacggtccaggtcttcaataaggatatcggcaaccggcttgcctctcagattctctaccggatacagcatcccgacagccagtttgagaccacctatatctcttcccaggtgattttccgcgcttccaccggagactgacggataaggcctgaaaaaaagaaatactgtcaggcaaaaaggcgtcgccgccgcactgaatgctcagtgcggcagcgacgcttctttcatcagataatataaggttgtcaccccggctccggtagctcctttgctctcataagcataggtgggagaaccgcaccaggccgttccggcgatgtccaggtgaagccagggccttccttcacagaagctgcggataaacagccctgccgtgatggtgccgcagcagcctccccccacattttttacatccgccacatcgctttttatcatcttctcatgctcccggccgaagggcaggcgcaggtagcgttctcccgaatgctccagcgcccgttcaaagagggcataaaacccatcgtcatccgacatggctcccgctatggtattgcccagcatattcgccaccgcgcctgtgagcgtggcaatatccagaacttttgtgattccttccctgcggactgcgtagctcacggcatcagacagcacaagacgtccctccgcgtccgtattgagcacctctattgtcctgccgccaaagcctgtgatcacgtctcccggaagcagcgctgactgggatatcctgttttcactcaaaggcaggcaggccgtcacgttcaccttaagccgctacgcggctgccgcgtgcatcgcagccgccactgccgccgcgcccgccatatcggatttgatgcctcccatggaatcactgcttttcagacagtagccgccggtgtcacaggtgattccctttccgatcagtccgtagatttcatcgctgtccggatttccccgataccgcagaatcagcaggcagggaggatattcactgctctgccccacactgtaaagcgcttccattttcagcgcccgcagctggccgtagaccagggtttccgcctcgatctccacatccttttcataagcggtgataatcctgtcaaaatccatgggccgcaggtggtttcccggcgtattcaccatatttctggcaaagcaaatccccgccagaagctcctgcgcttccttcagcctgtccgcatacgcttctccgttttccagctggaaatcgcagtcccatgcctcctcattttccaaaggctgataacggtagcggtagcagccaagccccagccccagaacggccgcggtaaatgcctccggcccgaggagctgcgtaaagcagctcacatccatggagcaggcccggatattgaaatccctgcattttgccgccgttgccgccagcacctcctttacggcggtaagccccggagcgaagtcctcctttttcccgcagccgatgagcaggacggcctggcccgtaaaaggcacaagcatcgtttccaggtacctgccgtgaaaaagctgctcaagacccagccggtagcttctgatacgggcgtccccttcccagacaaattcggcaaaacaggcgtcattccgctttccggttaatgttatcatcgttttcctcttttctgcccttttttcttaaaagcaaaatctgtaaaatcaaatccacactgcccacgtgatagcccgcacaggaataaatcccgcggcgcccctcttccgtgagcacaagcagagggagtttctccggatcagcgcccatcacggccgcagtcttttccgaagcttcctctctgtcaaaataaatacgcactgaagacagacgtgccagcgccctttgcagcgtggcattctttagttcctccggccttcgaagcaccgcgattatttcagcgccgctgccattccactgctccgcgtagtcattcagctcatttaacacatgctcggtcggttcctctcccgcgcccaggaaagccaccagcgccgtcccgcgtccggtgatatgggcaagggactgtctttcccctgatgcatcccagagaaaaagctctggcagctccctagccgggtaatcggaaagcatggttttttcatcgttttccccggacaaaagctccactgccctgtgttctcccgactgtaatccaaatacgctgaaggccgccagctgattgcctcccggcagacgccgtgaggtgacaagccggtacactccggcttccagctctagggtgagcgaatcccctgaaaagcaaatcccctcataaccaagtgtgcagaagcccgtcccttccagcttcccgatagtccagttctgtccataattccatttctccccgctttgtgcttcgggcgcttcaagggcaagcaatgccggcgccggcagacagcccgggctgtcttttccgcgcagtccggcgggcgcccggaattctccgttttccagatattccggctgcatggtgctgcgccggagccgggcgggtatgcccaggctgcggcagattgccacaaacagtattttccgggtcagcagactgccccactttaacttcaggcagccaatgggcgtcccgcagacggcgctgtaatccagccgggcatcataccggatatttttctctatataatcccataccagttccggcagccgggtaaaagcggacttttcctcctccgaaaaacagctgcggatgaagctgcgccagggcgtcagctcctccaggtaaatcctggggcaaagcagatacgggacatagatatcctccggcagttctccctgcgtacagttgagatgatcctccagcacacctgcaggcgcatccttgtaatccttccgggccaggctgtgcagcagacgctttctgtcagggtttccgtcctttttcaggaaggcgtacagctgcgccgcattttccccggcgatttgcagcatttccttctcttcagggaattcccctgcgggcagctgccccaggagggcgcggaaacgttcctcccgcaggcggacagcttcttccagccgccgctgcctgcgtcctttctgttcctccgactgacgggcgcaggagacaggggcttgcgcaggcgccgtcagcaatatctgttcccaggtattgcttcctccggccagccgttcctttgcgtcttcctcctgaataaaaggatatccgcttttcagcaccagctccgtcctgatttctcccgtccggttttccttaagcccgctgtcccgggctccggcttcctgcgccggaaataccattttctcacatacacagccgccgctccaggctctcagcctgacatcgccgattcccatggtgatgcctgcctcgccgttttcatccgtaaccagggctgccgccgggaaaaattccgccatattcagtatctccacagcgacccgcgcccccctcaccggccttcccgacgcatcctttaccgtaactgtaagccggcaggtcttcgcataggaggcggtttcattcaaatagtacaccccgtcttccctgccgatccattcctcctgcatgccgccgcagtcataatcgcagaagcatcggctgtgtatcaggatcgcccgtcccgccgggccggaaaaccatccccggtccagctcctcctccggctcacaggcgccaaggaaatgccacctgccgtgaatataaacctccacccaggcatgattatcatcacagtgcgcccacctgggcgcatagacctgcctggcggcaattcccacgctgcggcagacagccgccgcaaaggcggattcctcgccgcaccttccttttccgcagcggtacatggtcatgggggaagcggttctgccatccgtagactcataagctgcatgctccgcgcaccagtaattgatttccctgactgcttcctccagggaaagcccggcaatcctgtccttcagccgctcataaaaaaacggtctgcagtcgctgatatcctcggtattaatgcggtaataaagcacgtaatggacaaaaatatcctcgggcagccgtctgcaccactccacattgtcacgcagccacagcgcatgccgtacataggataaaaatacctcaaacccgtattcccccgcatcccgcaccggcatcgttccgtaaaggaaacgcatcagcaccgcttcctcttgcgtacagcaggaaagcccgttttcgatttcagaaagtataggggcatagatttccgcccgttcccggaacttccattctgcatagtcctgcagggcaggggacagcacagctgccgtttcagtcgctttcatgcgccgcctccccgccccggtttacctccggttcctgaactgctccagggcacagtcccccgcctggttcctgatccactccggggcatggccccctgcccggttcctgttttcccccagggcacagccccctgtccagttcccgccgcaggaagccggtcagcgtcccggtcccgtcacagcggtattcccagtacatgatgccgcccaggccattttcttccgcgtagctcaccttaagcgccatggactcctcgtcctcatagctgataaaggtgctgccgtcaaacagatagggcgatgacgcttcctcgtcccagtaacggataaatccgtttttgttgatataatccgctgtcaggctgccgtaatccggcccgtagccgcccacggtctctgcctcctggcccagtcccgggccgcctcccttcacgccttcccatttccgggaataaaagggaacgccaaccaccagcttttccgccgggacccccgcctccagaaaggcgtttaccgccttgtcaacacaggcgtcaaacaggctgcagtttccgggacgcagcgccgcatggtgcccggtcactttctggaagccgccctgcagatcataggtcatcagctggacatagtccagaaaaacagccgcttctttcatgttggtctgcctggtaaaataggaatccccgccagccgcaatggtcagcatatatccgccgccgacagcgtccagcccttctctcacagcctgtaaaagcagcgtaaaattttccttatccttcacatgggagccgattcccgccagggccattcccggatactcccagtcaatatctataccgtccagcccgtattccgtcaccagcgcagcagcgctcgccgccatgctttccctgccctgtgccgtcagcgccgcctgggaaaaaccatccgagccccagccgcctgcggaaagcaggattttaataccgggttttatcttccggatacgctccagcgcaggcctgcaggcctgcccgtcccaaaccatgcaagcgtcccgtacctgcccaaaggcaatattgattacatccaggcaccggatatcttcctccgttatgacggaaagatcccttgcgcccacatagccgattaacctcatcatcttctttcttctcctgtccgcgcgctcctgcgctttctttctatcctgtatactctggcgatcggcgccgtatccaaaggcctgcggggcggtttaaccagaatcccgcttttctgccgggtaaagggaatgccctcaccgctgtcaggcatcgtcacctttacgatactttcgatcacatcctccgtaaaaggcagcagcaccacctccggaaccaccgttttttcatcggggaacagctccagcgcataaagaatatcctcatcctttttccgggtaaaggcgatattcccctttttataaggctcgcagacacgagttccgtatatggcctcaccgtataccttcagccattcgcccattcccttcagggatgtaaccgcaccttttgggagcctgccgtccggctgaggccccacattaattgccagattaccgcccttggccacgatgtcaacaagcaggcagattacctcccgcggcgttttataggtatcctcataggcaaaggagaaggaggttcccagtgtaatgcagctctcccacggcactcccagcggttcctccggcacgcactgctccggcgtaatataattttcataagagccgcccactgtgcggtccgcgcacagcatgcccggctgccaccttctgatttcctcgatcacctcgcccagacggatatcctggcctgcctgggggcagacccacccggcgtcaaaccacatgatatccagctttccataatttgccgccagctcccggatctggttctgggtaaaggccacaaaacgttcccattcctcaggatgctccgccggaacataggaaggtcctctccacatatattcccctctgggaaaccccttcgcccaatagctgtccgtatgccagtccgccttggaaaaataggcggcaatccccatcccctttttccggaaggcttcgaacagatgcccgcagatatccgcatatctgtgggtatggaaagggcagtcctctccggtaattttgtaatcggaatacttgctgtcccacatgcagaagccatcgtgatgcttcgtcgtaaataccagatagcggattcctgcttcagcagcggtttccgcccacttttccggatcgaagcggatgggattaaaggttttgttcagcccgaaatactgttctttaaagcttctgccgtcagcctcccagtcgatgccggttcttgaccacccggcatccgcgtcggaaagcgcccaggactccaccactcccagctgggaatatggtccccagtgcatcatcagcgcaagcttctgatcctggaaccattccagcttctccagcaccctgggatccgtgggccggacatagccctccgcggcgctgtaattatgtactccctgcacaattttctcctccggcgcttcttcattttcccctgccgcgctgtcagggatttcctctgtcatttcatctgctgtctgcaatttttccatcatatcctcagtcattattcgtcaccacttctccatgtcccagattataagtaatttttccttccagctccaccttcagcaccgtggcaaagggatgggtctgcaaatcctgcgcccaaatccacagtgtccccgggatgccgctccacggcagcgagccggtataggaaaaatgaagctcctgtccgctgtgcagcgccgtcactctttttacaggtgtcttcacccctttgacgcatacgctttccagcggtttgtcatacaggaaaagataaaggacctgctgatccgcggacagcgtgctgcctcccagaaactgatggtagcttaagccctttcccgtaggatacactgcttcctcatgatcatggatccagcttcccagatccagcagcaccttttcctgccgctcatccagcgtgccgtcctcctttggccccacatccaaaagaagccttccgcccagcgtgatgcagtcgcagaacatgcggataatctgcccgctggtcttataatcgttatcgctgggccgatagccccaggaatcgttgatggtggtacagaactcccattccccttccggcccgtaaagagggatgccctgctccggcgtcccatagtcgccatagccctgcatccgggaattcagcaccacattgggattcaggctgtgaagatattcccggaactgaggcattttccactgtgccgcgctccgttcccagtctccgtcaaaccagagcaaatccacggttccgtaatttgtcattaattccctgagctgattattgttgaattccaggaactcctcccattttccatagtcctcctccccgccggccggggaaccataaatatccttcaggcagtcctcccgcttcgccccttccggataaatgctgcggtagcggggatccgaccagtcaatcagcgaataataaatcccggttttcagtcccgcggcattcatcgcctccacatattcctttaccagatccctgcctgccggcgttttcttcaccacgttcaaatcactgtatttcgtatcaaaaagagccacgccgtcgtgatgcttggacgtcatgaccacatactgcgcacctgcttttttaaaaagctccgcccaggctgccggatcataccgggaggcggtaaagcccccgcactgcttcatataattttcataggaaatattcccattatgaaaggaccaggactccgatacatcccccaccgcataaatgccatagtgtataaaaatcccaagcctggcctttctgaaccattcctgcatcataaaattcccctccgcttccaaactccaaaaatcccctgccgccaaatggcaaggcggcagggatttgtctgttcaactgtttataaagcttctttccagcttaccgccatcctggcggttttacgctggcgtgcacatactgcctgcccgcgaaggcgcagcttttattccactactttttcaataccgcggacatccatccagtcttccagtcccagcgcatacaggccgtcaacatagctctgccactgtgcgtcatcgtcaatatccatttcgccggaaatgaacattgcctgtctttggttgaagtaatcggtgagcgcgcttgcgatgtcggaatatctgtcgattttgtcaagcgggatccagaaagaaggaatggtagtcttggtcagataaggctcataggtgtcttccataaccttcttttcattataggtgggatgatcctcgatgtatttaaagccggaaggcatatatttgggcagagactgcggccacaggtttccccagctgaatttttcctgatcctcctctgaaagagtctttacatcaatggcacggtagccgtcgtcttccttgaatacaacggttcctacagggcctctgttacatccgataccgttttccagctggaatgcattgtcaaaccagcggcagatcacttcgggatgctctgcgttatcggtaataaccgcctgtgtcctgtacacactgaagccgttggtatctctcatccacatgccgcctttatccgtattcagtacggggagtacatcgaactcactcttttctccgccctccagaacaataccggagaactcaccgctgccgtatgcgatggaaaccccgtaaagatcacggtttcctttgccttcccaggtggagctgtcctgtgtgaaaatctccaggtcaatcaatccctgctcatacaggctgttgaaccagcttaaaaattcccggtaagtgctgcttgcgcctgcaaataccacctcgtcatccaggattcctatgcctgattttcccatgggcagtccgaaccagcctgtcatcgattcaatatgcttattgttggggtctgcggaaaacgggatttcatcgttaggatctccgttcccattcgcgtcctgttccttgaacgcctttaacacggcttcgaactcttccgttgttgtgggtatgtccatccccacatttttcagccatctgccattgatataaggagaatagcctaccttggtatcgtcacagacatagggaatggcatagatatgtccgtccggagccgtcatttcctcccttacgccgggcagatccaggatctccgtaattctggggcagtactcggcaaaataatcctccaggggaataaataccccctgattcacgccataggtcaggatcatactgtcgcttaatgtccatccgccgacaacatccgcgtaatctcccgagttcaaatccagattcagtctctcggtagccgtttcataagggaagatacgcatttcaacatccacattggtctgcttcttgaactcgtcaagcatatagtactcaggtttttccttggaatcgtcgcagaaaatggaaaagccgtaggttccctcgtccaccagcggcagccccaccttatacatgacgccgtccaccttgccgctttcatccacgacagcctccgatacctcccccgatgcattttccgttgtacttgcagtgctgctgccgcagcctgccagggacgtcacacacattgccgccgccagcactaacgcaaccgctttctttttcattctttttcctcctgttttatatattggcagccgccctttggctgcagctgcccgtattcatccggccctctgccggtaaacaccgcaatgcgtcagcccttcagggaaccaatcattactcccttgacaaaatacttctggataaaagggtataaaagcagaaccgggatactgctgataataatcagggaatatttcataacgtcaatcagctgctgtttttcccggagcgcagccctggccgcctctgtcgtggcggtctgcgccagcgccgtttcattggtaatcaggatattacgcagcaccagctgcagcggatatttttcggaatcggaaatataaaccaacgcggaaaaataggaattccaatgccctacgccgtaataaagaaccaaaatcgccgtgatggccgcggaaagcggaagggcaatcctgaagaaaaactgtccctgggtacagccgtcgatttccgccgcctcatacagctcttcagaaatattggatttgaaaaaggttcttgccacaatcatgttgtatacgctcaggcagccgggcaggaccagcgcccacatggtattgagcatgtgcaggttgcggataaccaggtaagtggggatcaggccgccgccgaaaaacatggtgaccatataaaaaagcgttacaattttctttcccccgaacctgtccctggaaagcgcataagcggtgggcagggttaccaccagattgatgcacacgccgcagaccgtgtaaataatggagtttaaaaagcctttcataacggcgctgtttttaaacacctccgcatagccgttcaatgtgaatccaatcggccttaagattaccttgccgccggacaccgcgctgggatcgctgatggaagaaatcaccacccagtaaagcggatatgccacaatcagcagaatcagagtcagtacaataaaaacaaccgtatcgaagatcacgtcctctttgcagcgtttcatcttctttttcctgggagctattttaggttctgtcatctcgttgttcctcctaccaaaggctgttgcctgaaagtttatccgcggctttgttaacaatcagcagcattaccagattgaccagtgtattaaaaagcccgattgccgtggaataggacatgtcgttattaataaggccgaccttgtatacatatgtggaaatgatttccgatacgttcaggttcaggtcgttctgcagcagatacgccttctcgaagcctatggaaaggatactgccgcagttcataatcagcaggaccgttgccgtaggcataatggagggaaggtcaatatgcctgataagctgcagctttgtggcgccgtcacatttggccgcctcatgcagctcagggctgattccggaaagagccgcaaaataaatgaccgaactccagcccatgccctgccagataccagtccatacgtaaatgtgtctccaatattcttttttcgccataaagttgacaggatctcccccgaaaaactgtacaatattattgataacaccaaccgaaggggataaaaacaggatgatcataccgcacatgaccaccgtggaaataaagttcggtgcataggtaaccgtctgaatcagcttcctgtattttttgtgccggaatgaattcagcagcaacgccaggataatggggatcggaaaggacacgatcaggccgtacaggctcagaacaagcgtattcttaattgttgatgaaaaatagggggattcaaaaaaccttttgaaataatacagtcccacccacgggcttccccaaatccccgctttcgcattgtacctgcggaacgccagctgtacgccgtacatcggaatatagctgaaaatgaaagtcagcacgacgcccggtatgcagaaaagccagagcgatatatcgcgccgcaatgccctcattgttgatcctttctttctcttttttttcgttttcatgcacttctcccttcttgagctgttattttagatgtttccgcggtacgttttttcctcgtcacgcttaacatttttaacatatgttcattatgtttacaagaaaactgcaagcacgctttttatcgtaattttccattaaattcttttcgtttatatgtcgtttttgttaggtaaataataactttgcacatgcactttgtcaatctgtttcatacatatttgttcattttttaccatttttacaaaacatataaaattattagtgttaaattttgttcattatgtatcttttgcatttttctaaaataacctttttatgagtgttggttttggtcatattttcgcttatttcgtatattattattttcctttcagtgacaatcgaccgtattttttgttctttctttactatagtgttcatttttgttgaatatttatgaacatagtgatacaatatcaaaaaaagcgggagaaaggatgtccggataaaccggtatccgtttcttcccgcggaaaagaggttcttatggataatatccgcattcctgtcccggccgttgattttcacccgcctgtgtattactgccgcagggcagggacggctctgcagccggacggaaatctggacaaggatttctgggctgacgctccttttacggatgaattcatcgacatccagggaccgcatatgcccgctccgcgtttcgggacacgggttaagatgctctgggatgatgaaaacctatatatcggggcgcagctttacggagatgagatctggggaaatgtaacaggacgtgatgaggtcattttccaggataacgattttgaaatcttcattgaccctgactccgacacccagcagtattatgaatttgaaatgaatgtgttgaatacggtatgggatttgttccttccggccgcctaccgtgacgggggaaatgcggttaacggctatgacatccacggcctgcgcactgctgttgcagttaaagggagcatcaaccggccggatggggaaaatacaggctggtccgcggaggtggtgattccctttcgggcgatcaccgaatgcctgccgggaaaaagggcgccgaaggccggggagtattaccgcatgaatttttccagggtgcagtggactgtggacaaggaagacggatgttacagaaaacgcaccgaccctgtaaccggcaatcccctgcctgaggacaactgggtatgggcgccaaccggcgtcatcaatattcattatcctgagctgtggggatttgtctttttttcggacgggcaggaagaagtgggccgcgcaggctccattccggaggatgaacggcgcaaatgggagctgagaaagctttattatgcccagcagatttaccgggatgagaatggtcattatacggacgattttacggcgctgacggagattctgcacagacatgcggctcttccggaaaatggaagggttctgccgcttgcttacaaaatctccgtgacgccgcatacgtttgagctttcctgtccttccgccgacggaaaacatatagttgtgctttattcttccgggaaggcggaggtgattacggcctgagggtacggctgacagcaatggttcgttttacaatctcctccacggggatccttgtatagctgtttacgctggagcagatgatctgctgcacaggcgttttccatttgtccggaattttgtcagcgccgcaggcgatccctgcgatggaaccgaccgtcgccccattgcagtccgtatcaaagccggtaagcaccgcatgaattaccgcttcgctgtaatcctggccgaagcacagcacgcaggccgtcactatcagcgcattgggaatggccaggcaccagtcaaagtgatcctcttccctgtactttccgtggatcgcctcctccagtgcttcccaggacgcgccgtccctccactggcttaatagcagggaaagctcatggtaaagccgggattttaacggaatctgcttcatggcttcctccacccactcacagggccgggggagaaccgcggcggaggcgatgagggcggccgtatacatggcggcgtaaacgccgttttttgactgggccaccactgcgtcgcggcaggccatatccgcagccagcgcaggattgcctgccgcgatatatccatagaaatccacccggatctgcgcgccgatccactcacggaaaggattggcaagacgcccggattccggcggcagcacgccatgcatcagattcctgtaggcaacgcgttccgccgtgcaggtatgaaaggcaggcagtccgaacagccaggattccgccacatcctccgaggtaaagccgctgcccgcccgctcaaggacgcgcagggagagcacggtataattcatatcatcatccaccggataggtatccatgttattgatccaacagattttctggcggtcataggcggtgcctggatccctgtccgtcaccccgtatttttcccggatttctgcatcagtttcggaatgcatatagcttcgcaggggatactgtccgctttccttgagaaagccgcggattttgctccggctccagccctctaccggaattcccagcaggcagccagatgccctgcctatccaggcgcccttcaggcgattctccagttcctcttccggcaccggacggcacaggctgctgccctgcgcggcctttcggatatcctcacaggcctcaggttcttcatatggaaacatggctttaacagggcaattctccatttccaacagaagctccctggcctgtttttctttttcctccccgtcttccatagcggcaattttctccgcccggggaagaagcgcctcaatctgccggccttcgtccctgcactgtctgatttcatcccctatgttgccgctgtccttcatccacagcattttttcctttaacatggcgtcccctcctgaatgtgtttatgcatgtgattatgcatgtatttcggcatgcatttatgcatgtgtttctgaaaatgtttctgaatttgcccctgaatatatcttctaatatgtctttgagcagaattttactgctgctattctttcactatagttgaactcaggagaggacgcaatataaaatacatgctttccatgtaaaacattctactttatataaaagtcccgataaccaatccgttaccctgctttcccataagggagcaggtaaatacatttgcctgagacagagctgaatacggctagtgtcaatgtgacaagacaccaggcactccggccgaggccaaatcagttttctccgccagatggcaaagactgcatgagggaaaagaaaaattcaggtctgccggtgctgaaatatccataccacgcttccaatgtatccgcctgaaaaacgcccaaatactcaataatttgtttcgtccacagcaaagcgcctgcgctgcccgccgtaatcaggttgttatccgccgctgaaggcatatccacataaaagccctgccccttatattcaggaacaaacatttcaagaaatcccggtccattactggtgtgaaggcgattatccagcagcccgtatccggcaagcgcagcggtggctccgcagatcgcacagaccgcagctccaacgaaaagaagcctgtccgccttttcgagaaccgctctgtgccttggatcattccaggtatctgcgcccggcaacagcagcatgcttgcttcactcacttcaatatcatcggtgatacaatcaggcacaattttcatccctcccatggtaatgaccggttccctggaacagctcaccgttttgagggtcacgcgcggcgcatcctttttgaaaaagcggcctgagttcagctctgaggcaacatggcccagttcccagtcggctaaagtatcaagaacataaacatagattgtatacataattctcctccatttgtgacagttcagacggaacgcaaccgctatctccattttcattgcagcttcgcccaaaaggcagattgatttgtaagcttttttattgtaccatgtgattactgccagcattatggcagcaattaaaataaaatccggaaaggcggctgcaaatgaaaatagacaggcttgtgagtattataatggtacttcttgacaaaaaccgtatcggcgcgcaggagctggcagatatgttcgaagtttcactgcgcacaatataccgggacatagacgcgatcaacatggcggggattcctgtccgagggacctcgggagtgaacggcggctttgaaatcatgccggaatacaagcttgataaaaaggttttctcagctgcggatctctccgctatcctgatggggctttccagtctttccaacatgattcacggtgatgagctgataaacgccctggcaaaggtcaaaagctttatccctgccgacagagccaaagacattgcattgaaagcaaatcagatatttatagatttaagcccgtggatgggcaacaggaacatgcagccgtatctggaggaaatcaaagctgccctgcaggaaagccggctgctttcttttgaatatgcagaccgttacggcaataaaacaacccgcacagccgaaccgtatcagcttgtattgaaaagcaatcactggtatctgcagggcttttgccgcaaaagaaatgactttcgtttattcaggctttcccgcatgtcaaagctgcagttacaggaggaagcttttacaccccgggattttcaaaagccccagctggaatttgcggatatcctggactccatgcagtcggaaattaaaatccgcatccatgaagccatccgggaaaaggtccttgattactgcactgaggataacttttctccggacggtgacggatattaccttgtcagcttccctttcatagaaaacgattactactacaatattcttttcagcttcggaaatcaatgcgaatgcctggagccgccgcatgtacgtgcggaaatgaagcgcagaatccatgaaatagctgctttgtatgaaaaccaggcataggctctattccgctcccacgttacagtgcatggatagtgtctacgatatccatgtccctgattttcctggcaggccctcttaccgccaacagggtggcagcgacggtcactcccactacaactgccaattgcaggaacggaacctgccaggccgttccccaatggctggtgaccatcattttaaatacgaaatggtgtgccggaatacccatggcaatccccagtatggaacctaacgccgcgtatacaacagcctccgcccttaccatgcgaagcagctggccgccctccatgccgatggccctcatcacgccgcactgattcatacggcttgtaacactcatgttaatgctgttaataatatgcagtacggctatcatcagaataaccgccaggaaaccgtaaacaaacaccgaaaaggaaatcataacagcctggctttccgccttgctctgcctggcatcggaaaatgtaagcccaagcccggcggcctgttccctcagctgcgttaccatttcctccgatgccccccttttcagctgtatatccagtatggtaaaggcattttccccggtaagctgacggaagctgtcttcagaacagatgaaaatgctctcgccattttcactgtcaaaaggactgctgccaagcactccggcaatctgcacctgcctgagttccccgttcagctccagttccagtctctcccccgtatgccagtccctgccttctcccgcgactgcaagcacctttccaggtgttccccgcacttcctcaatgctgccctcctgcaggaagtcctccgcccagccgaactggtgctcctcataggagaccaaataggacatttcctgagtctccgactgttccccggagaaagggacatcaaatgcaaacattctgccgtataccttatttatctccggattcttttccagttcctcgtatattttattttcaatggagcaggtattgtcggcgctcaccagggaaagatcaggactccagggacgcagcggccgcaccgcatgatgcatgaaatcaacgattcctgagaagctcataaacatcaggatgctcagggcaaaggacacggtcataagcagcaggttcttccggttttccagggcatgataaattcccagattcctgtccaccttaccggccctgaaaaaacgcatatttttcatctgtccgggcagccgggcattgccgctcaccgctgtaagcggggatacggaggatgcctttcttgccggggaaagggaggcgagcagacaggcggccaggccaaccgcagcccccgcagccaaggccgggatgctgatgccaaacagcgggatatctgaaaaatattccggattcatcacccgcaggaaaccgcacagcatccagatcaccagcacgtccacggcaagccccgccggaattgccttccggcagtagcgcattccttcctttatgacaaaacgcttcacctgttttctggttgcccccaagcaacggagcatgccgaaaaaacggatccgatccgtaacactggtctgaaagctgctggttatcatcagcaccgcggcagtgaggacgaaaaggaaaagaaccgcggccgttccgtaaattcctacgaaaaagggatcatcgctctgccccatcgccgccagaagataggcattttctcctatcgaatcgggagtaatgccaagactctccgcaattttcagtttctcggcctggatgttggtaaagggccggaatttgatataataggcactgctgtattcctccggggaaaacagtctgcgcagcgtttccaccgacatcaggattcctgcctgatccgcctttaatatggacgccgtatccccggcgacagctgtaatcagaagctgcatatcatcgccgtcaggccgctccagcgtgatgctgtcccccggctctattccaaaggtccgggccattgtcccggtaatcagggcttcgtttcctttatccggccaggttcccgcctccagccggattcccagttcctttgccagcgcctcatcaacgcctaaaatattggcggccttgccaaaaagcgtgtatccggaacgggagccaacgctttccagataacctgagacggcaatctgcgggcgcagggccactatctgctcctgttcccttgccatatcctttatcccaatgtgccagctgccgtattgttttttcattgagatctgctgtgtctgcagctccatatccgccatgccgaaaatcgtggcaaccagcgccaccgccagaaggataacgaaaaggctcatacggtttttccgtttgtgcttttcggcatactcttttaccagatcgagataactattcatatatagcctcccttccggcattcacttccttcaggcagccgtccgtcacctgaaataccctgtccgcatccgccgcaatgttcatgttatgtgtgatcataagcactgtctgacggtatttgcgggacaggctgtgcagcagggaaatgacctcgcggctcgtcctggaatccaggttgcctgtaggttcatccgccagaatcagcgccggatgattcatcagcgcccttccaatcgccactctctgctgctgtcccccggaaagctggctgggcaggtgcttccttctttccttcagccccagatttcccatcagctcctccacgtatgccatgtccggcttctggtaatccagaagcaccgggaacaccaggttctgttccacggtaagctcaggtatcagatggaagccctggaaaataaacccgatgttccgccgccggaatacggtcctttccttttccttcatggaaaaaagatccctgccctccaccagtattttgcctgcgcccggtgtatccagtccgcccaccagatttaacagcgtgcttttcccggaaccggattctcccaccactgccgcaaattctcctttttgcagcgtgaaggatacgtttttcagcgcctccaccttcgcatctcctgtgccgtaggttttgccaagattttctacttttaagatttccatcctgaacttcctttcttatgtttatagaattgatgctttcccggctgagtattccgggaaagctttatttatttgttgaaagtaagtataatggatgcgccttacgccaaggtgtatggcagcttgcaaatttgtaagattacctgatcagtttctactaaaagctttacttcagatataactcggcatacctgtttgcatccgaaaaaatctctgctgcaatgtcaggcgcattttccagtgttctgtccgtaattgtaattgtaggaattatgcctttccgcagaggacaccgtgttatcggattaaagcctaattcatgcacacccgtactcccccgtgaaacatctcccagacataaatggccgaagcctctggcataggtatcaaacataggtgcataggcctcatcatgccaatgaagtactccatccgtatgaccgcactgcagaagagggatgcaggcggcaagcccgtcataccatgcctcaccggccagcagcatatccgggttatgctgcttaaagcgtttcataagctgttttacgccatcatacagataatgattgggatcattcatccaaactgctgcaatatcaaaaaaagcagcgtcaaaaccgaattcatccatcagcgtagttacctggctgtataaacggttctgccatctgggggcagccggattcaaattgcggtttgaattatgatcatagtgcctggatccatcccaatccacacttccgccatactgacttcctcccggacctctgaattctgaaggaagcccccattcctcatagttttcaaaatggctgcccacaacattgattccaaacatcggcatcacatgaacgcccatttttttagcttccacgcacaatttcaagaaaccttcttttcctcccatccgctcgtcgggagaataatttccgtatttccagtaatagcgcccttcccaaccgggcagataggccaatacacgccgcccctcaacctgactgcatatttttttcagattttccaatacctgctcataatcgttaaatacataacccgtccaatgctgacaatgtatggctgctaccagtgagatttcccttgcccagtcaggaacatccttccttttctcccaagggacaagaccatagcaattttccacatgctttctgtgaggctcatagatttcgtcaatattttttcctttaccgatttcccattccggagtttcaatcctgcaggtcatttgaactgccgcctcttcaaaaataagttcagcgttaatatcctgcccggagcgtacaaacacaaatcttttgtccctgaccatatgatccagagaacggaaataaagcagttccttccggtccgtctccataataacaagcggcgtccccacatcacgccatccttccggatattttaggttaagcccctccttggggatctctctaggcagtgcgttgattaaatttaccagttttccttccggaagcccatgtattgttatcttgatacagcggatatcttccccctcattccgtatttccgccgtcgcctttattctgattccattatcacagacacatgctttgatttcaaccattccatccgtttccatctggccgccagcccaacggaatccatttcctacggccataatcccactttcattctcagtgatatgcatctttttttcatccggcgcgtatacattgcggaatgtataaatcattacggaaaactcaaatcccccaaagcaaaaatgcggcgtagggaaggaaaaacttaaatcctgcatatttcaatacctctctttacttatatttacctggtccattataccttttgcaggtactctttaatacgtgactgcatttcgaatatatttcctatactacggcatttctgttttttccttaacaggcagagtcaggagaactctggttcccttacctatcgcactgtcaatttgtatgccgtactgatttccaaaatataaccttatgcgttcttctacattcgctattccaacatggctgaacctgattccgttttcttccggtttatcaattattttccccggttcaaaaccttttccgttatcctcaagttcaatctgaagttcctctctaatagatgcgtgaataaaaattttgagttcctttccttcttcctccaaagtagaaaagccatggataatacagttttcaacaaatggctgtaaagaaaatttaggcagtaaacatccttccgtaccaggttccaaatcacattccaggataaattttttatttctcctaaatgccatgatagaaacataatttcttacatattctatttcctgagtcagcgtaatgagttcatcctggctgtttacaagacgcagcaatgaaataagggaggtcgtcatttccgcagcgtcatccgttcgttttaaacgtgccagggacttaatggaattcagcgtattataaaggaaatgaggagtaatctgagcctgaaggaaacgtatttccgcccttcttttttcattctgttccttttcaatatcctgaaccagctccaaaatcttttctgacatttggttaaaaccatcccccaactgaccaagctcgtccttacgcctgatttccacgcgtgttcccaaaacacctttttccatatgtaacatggcattgcttaaacgggtaatgggtgaattcagataatgatataaaaccatcgccgctattacggacagaacagccgtgatcacggtaaccattaaaaccagccaggtgatctgatgtatagatttattaatatttgtgagcggattaaaatataaatatcgccagccatttattttcgaatccgcaaaactcaccatatattttctgtccctcagggaaagcggaaccacacctttccctcccgacagctttttgtcctcatcctcccgtatcacctcctgcagctgcaatgcgtcagacgctgctacccctgccgtatacacaatatttccctgtccatccaaaagaatgcaaaaggcgtcctgttcaaccgttctggcaagcagttcacggaaataatccggcaaaaaattaatcaacgccacacctatattggcatttgccgctgcgtcataaattgtccggtaggcataaatggccggcccgtcctgtttctgaaagacctgccagtgtatggacgcatccgactgcaggaaatgagaaaacggttcccgccttgtatagtctccggacagattcaaaacggaactgttccctctcacaagaggcaggtctccgtcattccataaaaaagccgccatttccaatgaatccccatgttggtttatcagagaatccagtttggaggttaacagcagaagatccgaataatatatctcactttccttttctttgcggaactgcaaaaaaccctgtgtggattccgaggtaaccaaatcgttcaatataagttcaaaattgtacatggcaatatcaaagtttgtcatttgattttccagaatgctcatttcacttttctgtgtattttccgtaagcgctctgacaagcacacgatatgcaaaaatccctgcggtcaaagtggggaggagcgtcagcagaatcaggaaaaaagataatttatatttcaggctgatttcaggcaaattatgtttctcctttcacacattcttttccgtcagacagcttttccgatattctccgcaggtttttccggtctgctgcttaaataatctgcagaagtaccgataatccgggaagcctgttctgtcggctatttcccttgtatggagattgcttttgcaaagcagctgtttcgcctgttctatgcggattttattcaggaaatccgtatagctgctcccaacctcttccttgaataccttacagaaataggtccggctcatacatgcattatcagcaagctgatccagtgtaatattttcattgtaatggctatacagaaactgtaccgtttccctgatttcctttcttcctattttccttaaaataatattcgcctgtccgcagtccgtaataacctgctttagttgttccagaaaaagttcgcaggtatcggcactttccagctgtgttagcgctgcctgcagcgcatcacttcttccaagctgctgccaaagctttgttattacccactttttcatttccgtttccgggggctgaacacgaacaatcatctctgcaaatatctgccatttctcttcaagcttgtcaggcccttccgttatcatagcagccatcactctctcccattcctcttccgggaagcgtcccttcacaggcttgcgcacattgctccgaacggtatcataaccgctgtaaaatctgaaataatcatattccagaagcactccgattccttcacgaagttccttaagctgcatacagattttcccggagcacaaaaaggccggtatatcctcacacaaaaaactttccctcagatttctaatcacctgcgtaagaattgcagtcaaaagaagaaagcttacctcaggaatataaatcataagaaataacagctccggttttaacaaagtaccaaaaatctttgtttctccgcccgcatgaaactccgcttcctccactgccttccatacacggtcttcctcccgttttcgtcccctatcctccaacacagcgacaacaggaacccatgcgcctcccttcaccggaagctccagacgacgcgcctgggtacagagctgttcatcgttcaaatcaccctgaaacagctgctgccagaaaagtcggcgcaaatcattctgtgcatctctctgcatacgcagtattttttccctgtccagggcagaacgcctttcctcctgtattctttttgccatctgtgacaagaatcttttcagattttccgcttctatttcatatttcagcagatattcagccgcccctgctttcattgcttctttcacatatataaaatcatcataattgctcagtactgcaaaaacagtatccggatatcgtttcctggctgcacggataaaatcaacaccgctgacttcaggcatggaaatatcagttattaccaaatcaacaggctccttttccataattttcagtgcctgtccggcactctgtgccaacagcggcacctgaaaatcacagctttcccaacggatcagcttacggatatcctccaaaatcaaccagtcatcatctacgattaacacctttcgcatactgtcccctttttatttaaacagcaaaatccctgccatgagcagggttttgccgtatatccgctttccggcttcatctattacgtttactgttattcaacggcgtcctttgctgcatagtccaacagaatctgctgtacattttcagcaaactggtcggaggttatctttcccagcagccattcgtccatgacattatttactttctgatcggcctcctgatagtaagaattataaggaactttaatggtatggttcattccctcttccgcacaggttttgccgctttcatcaaccgcgctgccaaggctctcgtcaatcacggcattcgccacatcctttgccacaggaactccaccgccccccgtcttcgccaatgcctggaaggcctccgtactcataatagcttttaccgcctcccacgcttccgcttcatgcttgctgcccttgaaaatcacaaaggaatcaacgaactggcttgtatatgcctcggcaccatttcctgagggaatcgctgcaatccccacattgaaatccttaatatccttgattgctcccagccaccatgtaccgtccagaatcattcccagtcttccggccttaaacatatcgaaggcgctcataacctttgtatccgtaggccttggcatactgtaatcctctctcagcattgtatcaaaccaggcgtagacttccttggttaccgcatcattcatggtaggattcccattttcatcgaatacgttattaccgcctaacgacttattaaacattccaatagccgccatataggggcctgcagaaaatccataggtcttatttgcaccttcgcctccggtaagcgcctttgccatttcacggtattcatcaaaactggatgctttgttccagtctgaagacggatactccagtccggccgcatcgaacatatccttattataataaaccagataataattcagtcctgagggaaggccataatagtgtccgtccacaaatgcagaattttcaaaggttttctcataatatctgctcatgtcaaaatcttcagccatataatccgtcagatccgccacctgtcctttattgatcagcatgggcatataagactctgcgattctgccaatatccggagcgctgccgcctgccatctgtgtaataaccttttgataatattccggccatccggtacagggaaccttattaatttttatggaaatattcttcccgtccgcttccagctgccgattggcttcttcaatcattgcagtccagccatccacctcattggaataagctgccatggaaaaggatatctcaaccatttcccccggcctgtctgcgtccttttccgccgcagtctcctgtactgccccgacactgtccgccgtaccgttccccgtactgttttggcaggcacagagtcctaacaccatacaccctgccaataacattgctgctgtttttttcatcctcttcataaaaaaacctccttatatattttaatttgttactgcctttttttaaagaaccattttatcccttcaatccggtcgccgcgattccttctataaaggaacgttgtgcaaacagatatataacaagcagcggaagcacagctacggttgatcccgccatcaaaagcccccagtccaccgcataagcagaacggaaggaattgattatcaacggcagtgtaaacaactcttccgtattaagataaatgagaggccccacaaagttgttccagtttcctacaaaggtaaacattccaagagttaccaatgccggtttgcataatggcagcattatttttgaatagataagcagataacccgcaccatccagctttgcagcttcaatgtaagaatcgggaaccgtcatcataaactgtctgattaaaaatactccgtatgcatttaccataatctgcggtacaatcaacggcagatgtgtatctatccatcctattttactaaaaaccacatacaggggaatcaaagttacctgagaaggaatcagcattgttgcaaaaatgaggccgaataatttttttcaccgggaaaactcattttagcgaatgcaaatgctgccaaagagcttgtcagcaaaactcctgctgtggaaactaccgcaataaacaaactgttaccaatcgccctgcccgtagccgccagttcaaacacctctttataatttccaaagtagaacggaaactgaagcagcagcttaggcggcatttccagcgcctggctgtctgtgagaaatgacgttttaagcatccagtaaaaggggaaaatcattgtcaccgctcccaatgccagaacaacatgactcaaagatttagttatcaatcttttcctgttaattgtcataatttacccaccttttagataccagaaactgtaccgcacttaccgaacctgcgaacaatacgagaacaatgcttgccacgctggccgaacctaaatcaaaatattgaaaagcctgattgtagatatacattaccagggaatatgttgagaacatcgggccgccccgggtcatgatataagcgaggtcaaacatgttaaaagcatcgatcatgagcattacaaaaataaaaaaggttaccggtgacaacatgggtatcgttatatttttaaatttctgccagaaggatgcgccgtccatgtcggccgcctcataataggtacttgaaattcccttcagccctgccagaaacagcaggaaatagtaacccatcttagaccaggctgacatgataattaccgcgactctggcccaaaccggatccgccagccagcccggtccgacaactccaatcagtcccagcaggtaattaatcaatcccatgtcaggtgcatacaaccaataccaaaccatcgctatcgctaccgtagatgtcaccatcggcataaaaaaagcacttttgtaaaatgccagccctcttagtttttggttcgccaaaagcgcaagccccagtgataataccattgtcaggggaacaattcctaaaatgaatatggccgtatttaacagggttttatagaaaacatccccatcaaacacaaatacattccagaaattccgtcctcctacaaacttcggcacactcataaaatcccaggaacaaaaacacaatgctactgcaaataacaacggcaccagaacaaatataataagccctataatctgtggtgcaataaaaagataagcggccattatttccttacggcggaacctgctttttctgccggcgccggccgcccttttttccaatgtcatttcactcctcctctcttctgaacagaaacgatttatcttatgaaaccagcttatccttccggtccggcggaaacaatgccgccagattatgaaagtgtggattttattcttattcttttgcaaaaataaaaacacccggaaagcatatgaatttcttctgctctccaggtgtcgcccttattagatctttgtacttaatatcacattcattaaagcctgtcagccgttcttccatggaagaaacaccgtaaacaaagcgccctctcccaaggtactctccacacttatcgtcccttcatgcccttccacaatcgccttggccagaggaagccccagcccggccccttccccgtcattggagaaacggctcctgtagaatcgtttgaagatagcgtacatgtcctcaggatggataccgtttccgttgtcctttacctgaatccttgttccggttcccaccgcttcccaggaaatctctattttcccgccttcttttgtatgatccagcgcatttttcaccaggttggagacggcttcctgcatccagtccctgtcgcacacagtatagcaggccgggctgccctccagaattatctctttgccctccctctgcgcacgggtttcaaattccgaacggatatcctccatcagtccgcgcacttttacctcctggctgccgaaccggatcatatccgcatccagccgggcgattttaagcagattcaacacaagcgtctgcatccgttccagggcggccacggatttggcggcaaattttttcaccgtttcctcttctccgctctcctgctgaatgatatcctgatacataaaaagagcggccagaggcgttttcagctgatgggaaatatcggaaatcgtatccttcagaaattcctttgccttcctctgggcttccctgtgggaattcagcgaggatgccatttcattcaccgccgtggaaagcaacgcgaaatcaccttccccttcggcagcgatcctccggtcaaaatttccttccgtaaaccggcgcacattttcttccatttccttaagccggatatgctccctttgcagcagccaaaataccagaaataccgacaggccaatggctgtcaggccaaaaatggagtagacagctccccatttaccgcccagggaacgcatgacaggcatcaggtaaactgccagcgtctcttcatatcctgcctggcgcatcaacagcctgccctgcgcagccatttcttccgatatctccccggcaagcagctttgccgcccgggccggatccacaccggcctccagcagcgcgcctgccgcttccgcctgctgttgcagatacactttttttatatcctccatctgcctgaacagaaggaagccgcctgtgaatatcaaacataatatcaacgcggcgcttcccgccaaaaacctgcgtatatccctgtctttccctaaacttcccaccattaaactcctttgccgccagacttattccttccactgataaccaagcccccgtactgtgagcagatgcttcggagaagaaggctcctcttctattttgctccgcagcctcctgatgtaaacggacagcgtattatcgtccacaaactccccgtttccgtcccaaagcctgtcaaggatccgttcccttgtcagaatcatcccctgattcttaagaaacagacaaagcagccggtattcctgcgctgtaagctcaagcggctcctcctccagccaggccctgtttcccaccaaatccacccggataccgccggactccagcacaggctcctgtatcgcgcccgccccttttcctctttttccggctcttctttgcagcgaatgaatccgggaaagaagttcgttgagccgaaacggcttggacacataatcatccccgcccatatccagccccctgaccacattgaactcctcatccgcagccgtcagaaacagaatcggcacctccgaggtccgccggatccgttcgcaaatctcaaatccgttcccatccggcagcgaaacatccagcaaaaccacatcaaaccttccatccgtgtaaagctttccaaactcctccacactccttgctacctccacctcaaacccgtccttcttcagggcgtattccagcccgtcaatcaggcttccatcatcctctaccagcaaaaccctgtccttatccatttcacggttcattccctgtttccttccattcttcccttaattttctatctgttaaaaaaccactcacctgtatcccgctcattttcctctgcttatccctacattataaagtcctcctgcccaaaagacaatattcctgtccaatacgttcagtgcagcttcacagttcagtaaccttcccccctgtttttcacataagcaattgacatcgcctttttgctggattatgataggaaaggactattttaaccaaaaattcggaggtatatatccggccgcattataaccggagaaaaaaagatggaaaacttaaacatccctaaaaattacgaatcagccctttccctccacgatacccagatcggcattaagacggtaaaggacttctttcagacgctgctggcagaacggctgaacctgctgcgtgtatctgcgccgctttttgtagaccctgcttccggcctgaacgataacctgaacgggattgaacgtcccgtagctttcggcatcaaggaacagaatgattacgaagccgagattgtacagtctctggccaaatggaaacgcttcgcgctgaaaaaatacggtttccagcccggcgaaggcctctatactgatatgagcgccatacgcagggatgaggttacggacaatatccactccatttacgtggatcagtgggactgggaaaaaatcataaccaaagaggaacgcagccttgacacgctgaaggatatcgtgcgcattgtatataaggtactgcgcaaaacggaaaagttcatgtccatccagtacgattacatagaagaaatccttccccacgatattttctttgttaccacccaggagctggaaaccatgttccctgacaatacgccaaaggaaagggaatactatattgccaaggccaaaggcgctgtctgcatcatgcagatcggcgatacgctggaatccggcgaaaggcatgacggccgcgcgccggactacgacgactggtccctgaatgcggatatcgtggtttattatccggttctggacattgcgctggagctgtcctccatgggtatccgtgtagataaagaggccctgctttcccagcttgaaaaagcaggctgcccggaacgggcgcaactgcccttccagaaggctattattgaagaaaagctgccctacaccatcggcggcggcatcggtcagtcccgtatctgtatgttcttcctgagaaaagcccacatcggggaggttcagtgctctctgtggccggaggaaataatggcggaagcggaaagccacggcatccatcttctgtaggccgtatttttacgataagaaagccctgaccggcacacactgccggcggggcttcttcaaattacaattccaggaggcagctaaaaatggcagctgataaaacctttctccgtccgctcaccgaggcggacattgataccatctattcccttacctcagatcccagggtggcaaaatacatgcgtttttcaacccataccagccggaaggaggccgaggagcttttttatgaatataccaaatccggcaattccggttggcttatctgtctgacagaggacgaatcccctgtgggcattgcggcgctgaagcaggaggaaaatgagccggatacgcgctccatgtccgtattcctttatcctgactgctggaataagggctacagcaccgaagtggtgcggcacatgaaaaatgctgctgccgctgaaaaaatcgggtgtctgaaggcctacgtagtccaggacaacgcaggctcctgccgggttctggaaaaaagcggcttttccctgcaggaaatccttcattttcctgatatgccctcaggcctctgcatttataccctgcagctgtaaacgtgcgcctccgggctcgccgcaaaaaaccagctcagccattttttatgtggctgaactggtttttattttccatttattcctgtattattgtcccctgtttcttactgcacacgcttccctgtcattgtctgggaaacaatgctctccatcatatcagggcttagcgctccctgcgcatatccgaatacattaccgtccttatcaatcatgaaggtggtggggaaggaacggatgccgtagactgaaaatatttcgccggtggtatccatgactacaggaaagctgtagccgctgtcactcaggaatttttccacttcctcctgagtcccgtcctgattgtagggatattcatccgactttggattggcaatgccgagcactaccagatcttcgctgttttccccgtatttttcatataacgcctggatgtcgggcatttctcccttacagggagggcaccaggtagcccagaagttcaaaaataccgttttccctttataatccgaaagcgtatgggtttcaccatactgatccaccagtgtgaaatcaggcgcaggcgtctttttctcctcagcctgtgtgctctcctgagcggctgtgcctgaagagtcgctttctgacgatgcctgtccggactgcgaaggggtattcgatgcggtttccggagtgctctccggcacggtttcagccgcattctccgtttccgttatctgggactgctccggcgcatcgccaagctgcgctttggaaaggtagctggtaatgccgttcataaatccggtaagagtcataacacccatcaggatcagcagcgccgcgccgacctttactgtatattttaccacatttctctttttcttaaagaaatcaagcacggagccggtgaagattcccactgccaggaaaggaatgacgaagcccagtgtgtatacgccaaccaacaggaatccctttgccgaagaggaggaagaggaggccatcaacagtacgcttcccagcgtaggacctacgcagggtgtccaggcgaagctgaaggtgaagccaagcagcagcgccaccagcggattcatggaaaaccgatccagccggaagggcaggcggtgctctctctcaatggtttcggatcgtccgaacactcccagctggtaaagaccgaacataatcatgataattccgctgatccgtgcgaaccacacccggttgttggtaaagaaacgccccatcgccgagaagccgaagcccagcaggaaaaaggtaaaactgatacccaatacgaaaaacagcgtatttatcaacacctttttccgtggataatgtacaattccattttcgtccactgtcttggtcccgcctgccagatagctgacatacagaggaacaaggggcaggacgcagggtgagaaaaagcttaaaataccctgaataaacactgtaattaccggaactccggtttcaactgaaaaacccataatcatctccttagctttcttttatatattttaatgtaactgttcagtttttctcagtaactgctaacctccatcctgaatcgcctttagcgatggattgaatctcttttttacggtcattgcaaagcgcttgcctgcgcagctacatgtgccggcctggcgaacagtcagatttaatttaccgctgtgaacaaatcgttcagggcctcgctcatggtaggatgcgtataaatattatctctcagaaccgtgtagggaatacctgcatccatggcaagcttgaacaggttgattatttcataggattccgcgcagtacagatgcgcccccagaatcagtcctgtttttccgtcaatcacagccttcatcatcccggctgtggctttcagaacgcgcgccttgggaaccgccgccatctgcagccgtgccgtttttacttcatagccggctttgcgggcttccgcttccgtcatacccactctggaaagcgggggatccagaaatacactgtagggaaccgcgcctctgttggcggtggtacggctgccgtcacccaatatctgggattttacgatacggctgtcatccagggatatataggtaaactgcagacctcctgccacatcgcccatcgcccagatatgagggacggacgtccgcaggccttcatctgttttcacggcgccgcgctgtgtcagctcgatacctgccctttccggatgaagctcagccaggttggggcgtctgcctgtggctaccagaattgcatccacactcagttcctcttctccgccttccgttctaatggaagctatggctttcccgttctcatcccttactgcagttaccgctgcttttctgagaatccgcatacccgctgccgccatatgctcaaggacagctgccgatacctcttcatcttccctgggaataaaggcttccccatcctgcacgatggttacctgggagccaaaattggtatagtaggaagcaaattccagccctatatagccgccgccgataataagcagtttctccggaagctcctccagttccatcatgccctcgctcgtataggcataacggctttccttcagccctgtaatggaaggtacaaagggcgtccccccggtattaataaatattctctttccgtacagctcttccgtatttccttccggatatgtaaccagaattctgtggtcatccagaaaagctgccgttccggtaagcacttctactccggccccaacggctttattataatttttctgacgaagttcagctgtcagctgccttttttcctcaattaccttacggtagcggtctgccttttcctgaaagctcccgccctccgccgctgacattctggcgttgttttccaaaaatttactggggatacaggccacattgatgcacgtaccgccatacatcttatcggagcgctctatcagcgctgtcttttcccctttagaagcaagagcgcctgccagggtctttccgccttttccgaaacctataattatattgccatattccttcatttgaattctccttgttttgtgaagcaaaaatgaaatttatctgcgggcagaagaattatcccactgctgctttcgcctgtttttgcgcccgtatttctatcagtttccgttctatctcgcctatcgtaatcgttttcagcttctccaggcacatgtcatttaagttcaggtagatttcatccatcacatccgccatgcccgaagcaatcatacagttcatatcactgtccccgctgcgccaggaagcttccacaaaccggatgtctaatgcttcggcaacccggtacagcgtaatatcttccgcctgctccacagacgtataaccgcccacctttccttcctttgtctgcaccaggcctaccttcttcagcttagccattacttttcttacgcgggccggattggtacagatattttccgccagctcttcactggaaattgtgcatcccttatgcttcagaaataccaggccatgcacggccacacaaaaatcactgttcaatacattacccccttctgcgttattgcgcccatattttattttcatttgtaactgtaattatttgttgtacactttatactgtaactatagcatttacagatatagttgtcaatcccttttttcctcttaacattattttttccagttggataaaaatgatattaccataacacatacaaaggcacttgtccccacagattccctggacaaaacttattgcttatgccgcctcctgctcctggaaggccggaccgtttctggcaaaggatagaatgtaccggcggaacagcaccgccggcaaagggaatcatggtaaagccttctgcaacattttaacgcaaaaaaatgcgccctctgtccggagggcgcatacaaaccgcaaaaacggccatcagctttataccgcagccacatccattaagtaacagatgtcaggtattcagccatatatacatatatatattcaaaaatcaggcaaacatcacagcatcagcgctgtactcttcccgaggcatctccgcctgcaagctttgaaacctcatccacggttaccatgttgaagtcaccttcgatgctgtgcttcaggcagctggcagcaacggcaaactcaatgatctgctgaggctccatattctgcaggcagctgtaaatcagccctgcgccgaaggaatccccgccgcctacacggtcaacgatgtgcatcagataatttttgctgaaataaaaatccgttccgtcatacagcatggcagcccatttgttgtcatttgcggaaatggacgtccttaaggtgattgccaccttcttaaagccgaatctgtcagccagctgctttgccacgtccttgtagccctcgtgatttacctgtccgctggttacatcggtatttgccgctttgatgccgaatacatctcccgcatcctcttcgttggcaatgcagacatccacatatttgcagagttctcccataacctgtcctgctttttccttactccacagtttatttctgtaattcaggtcgcagcttacggtgattcccttttccttcgctttctttacggcttccagacagatttccgccacattgtcgcccagcgcgggagtaatcccggtaaaatggaaccagtctgcgccttcaaaaatcttatcccagtcaaaatcctcttttaccgcttccgcaatggaagatccggcacggtcgtaaataaccttggaaggacgctggcttgcgcctttttccaggaaataaatacctacacggctgccgcctcttacgatacctgaggtatccacgccgaattttctcagggaattcacccctgcctgtccgatttcatgcttcggcagtttggtcacaaatttggaatccaaaccaaaattcgccagagatacggaaacgttcgcttcccctccgccataggttgcgccataggtatccgcctgtacgaagcggtaatagccttccggtgcaagtctcagcatgatttccccgaatgtaactactttactcataatcttcctcacctttcctttatccgtttctattatttctgtaccagatgaaccgcaaaaccgccgacttcttccttcagataaactgccttgaggctgcccttgtcatcatattttgcactggactgatcaaattcaacaccctggtattcgagataattaaccgctctgttgataaagttagtcctgatgccgatatgtcccttagcgcccagcccgggtgtcttcatcacttctactgcagttcctgcaaatacggagctggcgccggttttcttcgtaaatccgaaaatggattcaaaacgtcctgctgttttgtcagcagcatcttcatccgtctcattaattcccacatgcgccagttcaaagccaagcatcagctgtaccgcttctcttgtaagcgcttcaattttatcaaattcacccgcattgatcagctcgctcttcaccatccagcttccgccgcaggcaataattttattaaaaccaagatattcattcaggttcttggcgctgattccgccggtaggcataaatttcatatttacataaggagcggacatcgctttgatcatagccaggccgcctgccgcctctgccgggaaaaacttcacaacatcaagccccagggaaatggcgatttcaatatcgctgggattcgaacagccgggggtgacgggaattttattatccacacagtattttaccacttcgggattcagcccggggctgacaataaaggtcgctcctgcatccatggcttcatctacctgttttgtggtcagcacggttcctgcgcccagcagcatttccgggaacgcctttctgatggcggcaatcgctcctgctgcagcttccgtacggaaggtcacctccgcacagggaagaccgccgttgcaaagcgctgctgcaagcggcaccgcatcctccactctgtcaattttcacaaccgggacaataccgattctgctgatttgttccaatacttcgttcattctctttcctcccctttttaggtgataggttatttattcctgcgtacaacggaccggatggctgcggcgggcgcagaaaccaggatttgtagatataatgtcgtctacgctgacattatatcatgttttatctattatttactatatcatcttatttcttccgtatcttgttggtttttttcgtaaatatggttttttttgaaccattacggaaaatacttataatccttattatcctttgccattctgatactgctttcatgaacggctgctactttcaaggaaatacgctcatccggccggaagaacttctgccgctggacagcgcccggaatccccgcaccaatcagggaaagccaggcttgcccgtctgattcagctgttggaaaatgaaggccgcattgcagacattttggaagcggcaaagaatgccgcggtcaggaacagattatataaaaaatacgggctatagcagcgtgtgaaaacggactgctataccgcccgcagaaagagagggactcttccattcattggaggggtccctctctcttttccttacaaaaataaacagtgactgtccagcgctttcacagttacaataaatactatattaccccaaatccggttccgccagcagggaaatactgtctgcgcattttccttccgattcaaaaagaatgatttcgttctccccttttttcagaagcgctcccggcagatacagccttttctgcgggcctgcctcccagaaccttcccagatggaagccatttacaaagacacagccctttccccagccgctgcagtccaggaaggtatctccaggcgcctccaccgtaaaggcaaaccggtaaaatgcaggcattccctcatcatagcctctggtaaaatccagcttctccaggttatccatgggaaggcagtactgctgccagccatgctgggcgaaacaatcgtttatcataacgcagccgtcgattcctttcctctgccagtttatcataggcccataattgacccttcccatgttttccatgagaatatccagccggatatcctgcgatactgtcggctccacctcatggcgttccagaagctccctgtccattgcagtgagaatcctttttccatcggcaaagcaaatggcccgatccgccgcctgataaagcctgatgctgtgcagctgtctctccgtatgcagaaccgaggaatacagggtataaccatagctctgccccagccgttccatggacatgggactgagtgtctctacaggctccgccaggcagtccagcgcatggaataaatctaccttctgcgaaacattgcaggtgccataggcagttctttcccggaaattcttttcttccccatcttctccggataatttgctgccggtaatactttcatccgtctccggctccgccccttttccgcgatgcctgctgatgatctcctggaaacgtctgtatttctccgtaatctgtccgtcctcggtaagcagggcgtcataatcgtaggaagtcacatccgccgtcaggtgatctccgtaattggatccgttcataaaaccaaagttagtgccgccttcaaacatataaaagttcacatttcccagctccagaagctcctccagctcctttgcggcaatttccatattgcccttatggtgcttctcatcgcgccaggcatcaaaccagcctatccagaattccgtgcacatacagggaccgccgtccgtatattcctccagaatagaaaaagcccttttcgtgcctgagccgaaattcgcggtgggaagcacaccgtcaatcctggtattggaaagcatgttatgccccggcccgtcggatgcaaaaagaggcaccgtaattccctgtccgcgcatcatatcccgcaggctttccagatatttcttatcattgccgaaggagccgtattcattttccacctgaagcatgatgacggggccgccgtgatcaatctggagcggcgccagcaaaggcatcagcctgtcataataggctctcacatggcagagaaatctttcatcgctggttcttaaggccatatccccctgcgccagcagccaggcgggcaggcctccaaagtcccactccgcgcagatatagggcgaagggcgcagaatcacccacagccccagctgctgtgccttccggatgaaagacactatgtccagcatgccgtgtaccttttccccataaaagtcaaacctgcccttttcaggctcatgcatgttccatgggatgtaggtttccacggtattgcagcccatctccttgagcttccgcagcctgtcctcccagtattcgggaaggaccctgaaataatggattcctcccgaaataatctggaacggttttccattcagataaaatttgtccctgatttcaaaggttcctgtgtttgtcatcataatagattccaatttcagtcaatgaagtctttcctcttgctttaagcactctgaacctcagaacctgcgtatgtaccgtggggaaacggcatattctctgataacccactgtggcagccctgtaaatttcctgaaatccccctgctgccggaatctccaggcaaaattcctcaatatgctgtccaagctctatggtttccttaatggtcaccagatttatttctttttcccctatcagatgaatttcaatcgcaggaagttcttcggaagcggcttcataaaactgtcccctgtccttatttagtaccgcgccggcatcccttccctttccggctgcagtcgtctgattatatcataatagccatcccaatcatagtcctgaagtttatcttttgaacggcaggcgccgtcaaaccagacgcagaacagttcaccgtaattactgcacagctccgacagccagtttttgaaaaacacgtcatattccggtgtgccgtatgtcttttcatgcatttcccatggggaaagataaacgccgaacttcaggccttccgcatgacaggcctcggagacctcttttacgatatccccttttccatccttccacgggctgttcctgacactgaattccgtatattcactgggccagaggcaaaagccttcatgatgctgacaggtcagcagcaggcctttcatgcctgctgccttaaatgccctgacccactgatacggatcgaattccggatgtgaacagtaacgcgcctgcatatcataatagtattgcaaaaggaaatacttgttttcttcctaatcctttgctattattattttgcgaaacgaaatttagcggataaattcatggcggtgtttcagccgcttttctgaatgaatctttgggaactctcccatatattccaatgttcaaataataatcgtccggtataaaaactatcggcaaagttgtttttttctaaatactaattgatttttgtcgttaaaaaatttataattacaggagataattatgggtaaaaaagatattaccctgaatgcttttctgggagatgtgcatatttttgcagatcttctgaatggatgctgctttcagggaaaaacaatcatccttccggaagagcttctgccgttggacagtgcccagtataccagcaccaatcagggaaaacccggaaaaaaatacagagatttgaaaaagctgtggtatcaggaagaaccagttgccatatttgcggtagagaatcaggaatgcagagactatcggatgcctgtccgttgtatgcgctatgacgcggatgaatacgaacgtcagattaaggcttttgaagcggaacaaaaatccgtcagtataattttcaggcctgggaaagccatatcgctgctgcccgtgctgaccattgttttatattatggacaggaggaatggacggttccccgcagactgtccgaaatgattgcttttcgttcaaaaacggcgcgcttcagagaacagattccggactatcctctgcgcctaatctctgtaaggaaagatatggatattgaattgttccatactgagctgagagaggttatgggaattctacagcgtgtggatgacaaacgggccatgcagattttttttgaaaataacagagccgctttttcaaggctgacggaacaggcctttgaggtaattgtcaactgtaccaattcaccaaaactgagaaaatatatgctagaaaataaggaaggagaatgtgttgatatgtgcagagcttttgaagaatggatggaagactgcagggcggaaggtataaaagaaggcgaaaacagatttgcccggctgatacagctgctggaaagggatgaccgttattcagatatttccaaggctgcggacaatcctgtcatcagaaacagactgtacagaaagtacggactgtaaaggttttgaaaaaagtaccgatatataatagatcccatatacgtcatggataaataaatatagccgattatgcttcagaaacagcctcaccgactgaccgttttttcgtgaacatattgagggattcttccgttcttaatggaggaatccctttgttatttcctcaaatatcagttcatttttcctgtatttaactgatatcctggcatcctgcgcttctttatccgaagttgccagatatattctttccacatccccgtctgtaagtacagtaatttccagcccacgctgtacctggggctgttccttttcccggttccaataatcactgcatccgcacaaatttatcaggctgatactctttgctcttttgctttgacggataattgtccagattctgccggctgcctaccggaaattttacctagcccctccttacagatgcacttcatggatccatctgtgcattactttcccctgacaaaccagcccgtatttccgagtcccagcaaatagcggaaaatgcccgtaaatacatcctgtcccattatcaggagcagataagtctttcacagatagcagaagaaatcggcgtcaacagctgctatctgagtgatatcttccataaatatatgggggagccctgttcccgctatctgcttcgcattcgaatggaacaggcggcccggcttctgaaagaaaatccagaagaaaagatatacaaaattgctgaacacaccggtttcgtcagttacctttgccgttttgaaagaacactattcatcatccttctcaaaatatttatccctccacttccggccaatctgctgcagccggattgctgtctgcgccagttcgtcatactggcgttttgcctgcaggagctgtttttcatagccttccctgcatttggccagcttttcctcgtattctccccgcaggcggtttacctttccttcgtattccttccggcactggatcaagcgctcttcccgttcctgctgaagttctcccatttttgccaaggccactgcctgtatttcttctttctgaagctcccagccttccttttcctcctgccaggccgcctgaaggctgttcagcctccggccgtgctcttcctctcccacctgccgcctttcttcaaaaataagcccgctcttccattcaaaaacccggacctctccgctgattttgtccacacaggtaattactgtccccgcatccgttgccgtcacatgaaaccctagcgcattttttcccacaagatcattcttccctgccagatcatttctcctgcccttctgctcctggttctcatcctgtccaccgccctttctggcgccgtccccgacagggctttccttttcaaagaccactccccggcagttctcctgatacggcatgcatacgtaaagtccataccccctttcccttccggaaaaagcctggtagaacagatacaaatccccgtccctgactaccagatgcagattgcagaatccgtacccaagcggtccgtccgtaagaatgatccgcgcagggccgtttcccagcgtatccagtataatcgtatgctccaggttttcatacacataacacaccgtatcccgaaaaacccgcgcctcaaaatgcgccagataatctctctttacctctattggcagcatcccccttgcaaagggcagcaggcagtataatacggagttgccctgggcatacagcgccactctctgtccatccgacatttcaaaaatctggtaagccatggtgtttcctcctttatatccacttcgcgttcactggctttacaataaatatatttccaacactgaacaaaaagaagcgggatgcataggatatagtaagtatttttataaggagcattccatatgcctaactgcaaatccaaaaactgcaaatgctgctcaaaaagatatgtcagctgcggtattgacaaaaaaggcaactgcctggatgtctgcacggatcctatctgcggtgacccggactgccttacggtcctgaccccggttgtatatgatgagcttggtatcaacctctgccggaatatcccgctggagccgccctccacaaatgtagaaagcatttccgtacaggttatggatatcacatttgaaacctgcggcgacgcagccgtatccgctgtcccgatcagcggaaggcccaactgctatcttgtgacgctgactaatctgcaggttgtttttttcgtaactttttacgactgtgcaaaacgggtactctgtacacagaccgtatgcgcaaactacctgccctatgacgagtcctccgcagactacgaatacatggatgaagacaccaatccctcctctgtggaactggaaatttatgcaccttacggcgtagcccatgccgatacagccgatctcccggctattgtccacgttatcggcttcggagcctgcaatacctcgctgacccagggactgaacctgattgcaatccccaaggtccttaactatgatacagaagatgatattgccacaatcgggctgagcgttatcctgaaatccgtttatttctcccagtataagcttccccacaatggaaaagcggtggtccccaaggcctgtacccgtcctacggatgatactatctgccttgattttgtatgcggcgaccttcttgacctggccatcaaaccgctggagctgggcccgcccaaatacgaagagactcttaaggattcctgcgatgtcccctgtgacgttccctgcgacccctgctgcgccgccacaccaggttccaagggctgcaagcagacgccgacggcggaaaacgactgaccttccggcagcagaagggtgctgctaaaccagcacctttcaagctgcggttcagccatacaaaatgattgccaggctgccttcagcgctccgttttcgatggccaatccgtccattcctttccacatggcaaaactgccgccttattttacttttttgtcgcccgaaacggtaaagtatgataaaatcagtagaaaagacataactgttatatataaaacaaacagttattaaacctgcccatttgccgccgggctcaggcggataccagtgctctccccagcaaaagaaaggacatgccatgactatcaatgataaaatcccgtatctgtcaaccccgctcccggaagatattctgcgttttagcagggccggatattttacaaaggcgctttccctcatcgaaggctatctggctgaagatattccggaagccctccggggacgtctggagctggaaaaaatcaggcttatccaccttcccgcggattttccctacacctatccacaggcaatggcgctcatccatgaaaccattcctgattttaccgacgaagaatttgccgtcctggaggatgccggacggattgactgtatttttgtggagggggagaaaaaatatttttcccgtttctttgaaacgctcaccgccacccacccggacatcgcagcacgctccaatccctcgcttaccctggaagccgcccgcaaagcgcagttccgacgggaaaccatgaaaaagatcatggaagacggcggactgcagtatcacatccatctccgggccggactgcaggtcaaagacgaattctttgcccccggaaaggaaatgcttgtccaccttcccttccccaaggaaagcagccctacctcccacatccgcattctccggacaagccataatcctaccgcgctcgcgcccgtggatgcgccgtcccggaccatcgccttccggaccacgcttacggaaaacgccgccttctgggtggaatatgaatatgacagtacgatacgttatcagaagcccgatcccgacggggtatcccccctgcagccggactttgatacggacgaagtgcttccccacatccgcttcacgccctttttacgttctcttgcagaggaaatcaccggcagtgaaaccaatcctctttgcaaggcggaaaaaatatatgactacatcaccacccacgtgaaatattcctttatgaaagaatattttctgctggatgatatcccggaatactgcgccatcaaccggaaaggggactgcggtgtccaggcgctgcttttcatcaccctctgccgtatcgcaggcatccctgcgcgctggcagtccgggctgtccgccacgccggaatccattggcccccacgactgggcacagttctatatcgccccttacggctggctgcacgccgacctctcctttggcggaagcgccttccgcgccggggatgaggaacgcaggaaattctatttctgcaatctggatcccttccgcatggttgccaatacggagtttcaggcgccgctgcttcccgaaaagaaagggctgcgggcagatccctatgataaccaggtaggggaatgtgagattgaaggcgtggggctttataccacacagtttgaatatttccaccagatgatcgatatccatccggttccctgcgatttcccggaggagtaaagacatgacgggagctgcccctggaagctatttttaagccggaagccattcgggaagacatcccggaagccgttttaaagccggaagctatgaagcctggcttattcttccggcctaaaaccgccgcaggcatcaaggtgcctgcggcaatcaaataccccgctgcaagcagcggggtatttgaccctcgcggcagtcgccaaatatccatgcaagcatggctacttggctcgttgctcgcgggaataaaaaaagaccgtattgtaccggcgcatccaccgtcccggagacggcggcgcgccggtttcctgccgccatgcggtcaggaaatgcaatcggtcttttttcattccaagtttacagccggtgtttcctcagtccagatgaaacactgtctgtaagtcaatgcttaccgggctgttgtcagggtttgtttccatgatatcagccatataatcccaccattttctgttgatggcggtatccgcgcctttggcccaaagctcctcgtcctctatctctatgtaaccaaacagcgtcagcgtttccttatccaggaatattgtatagttctttccgccatgctcatgaatcatgtccttcatttccggccagagcaggttatgccttctttcatactccgcttcctgtccttcatacagcttcattttaaatccttttaccatttttatgcctcctgcatatcgcaggcctgcctgcgatactgccttaataagtagtttaaaaggaacttgcctgcaaaatattacttctggattttttccacacggaacctgcacgttcttttttccgcggccggatctgccggcacatcccagctgatgcagtacacgttttcctccacgcccttgtggttcatgtgctttttctgctcccagcggatgctgccttccagctcctccaccgtgatcaggcatgcatatttttcaccttcgatccgtatggtattgtcgtttgcaacggggacaaactgcgttacaaggttctcactcatggaaaccggctccgaagactccggcgctcccccgggcagctttgccgccgtaaggcagtcctccacgtaaagggtttccatcgcacagtcataacggagcgtacgcgtaagctccttcaccttatcatttccataagcgcccgcaaaggaaatgatggtttctcccctgccgtccgcttcaaagcggctgcaggaatattccccgccttccttctgtccttcgccgtcaatcaccggaacgctgtgtccaaaggaattattgcagaggatccggtacctgccctcatgaaaatattccttcgtatactctcccgcgcccagatccgtcagcagcatttcatctcccacaagatagaaaaagcttcccacgtcattgtggttgtgaggctctccgttattgccgcccttggccgccataccgccgccggaagcgcctttgcagatactccactgggcatcggcaagcacgtcgcagccgcgctcctccccgtttttctccgcctggggaagggtgcctttttccgcccgctccagatactgctgtgtccagatcacatcccttaagttggccataaaacggtagcagctgtccccgtcgaagccgcccgcacaggacacgggaggaatctccatcccggcataacgcatggcaaggaagcatgtcagtcccatcttatatttgtccctgctgtcgccgtcggaaaagctgagcgtcctgcctgacgggaaaaagcatttctgctggaagagggcgatctgcctgcatttttcctgatccatcagatctgtctttccttccgtataccggtaaagcatatcggcaaaaccggtatagtaggtcataccatatacgaaatagctcaatccctccatacatgcgccgtcatcggaaaaaccgccgatataggaacgaagggaacgctccagacgctccagcagcggctgcagccgttccggctcctcctgcatcagggagagcgccgcgcagccgatgctgccgcagcataccgcattccagttattgtcgccgccttcccagaaattatatggcggccgggaattcataaaaggctccaggatacggcggaaaacattgtcccgtaccttttcccgcaggctttccggcagccggtctcccaccaggctgatgatctcagccagagcctgggctgtttcggaggcgaacaaatccacgcggatacgccagtccggatcactgtccctctccacatgggcgggcagcgcccagcattcctcttcacagatcccatccagaacctcttccagcttatgcaggtattccggctttccttccaatatggaaaggcagccgaacaccgccagcatcttgcgtctggtaaaatacacttcttcataaatcagccggttccctgtcttctcataaagggcaaacagttcctctccggccaccggcatgggctgatccatcatctcagccgcatgcgctctcatacattcacaataggccttcagataggcctttatctcttctgtccgcacctgtttctgctctgtcatttctgctcccatctgcgcaccgcagcgcgtatataactaaaaccgcccgccggtcaggcctccgcaaggttgcatccggcagccggcgttttttccgacagccggacggctttcattcagcatccgaaggttctttttccggctttccctctgtatcaggcgcgcgtcagttgcctgcggcctctttgccgtacacctcgatctgtgtcagagccgggaagggagacggagcatccgctttgattaagtcgcccatttccagccaggtaatggttttcttttcaaaagtaaaggtatggggaagcaccgatttttccatgggaagctgcatttcgcttccgtctgaaaatgtgattttcccgtccacccaccagttgtcgtggggaaaatctgccctggtatacaaaacaatagtatccacctcaaccggacggccgaaatccagacggatcctggcgtcatcctgacggttaattccccaggaggcatagggccacgccccatgggaacggttttccgtcacgccgtcaatggcattcatcgccgcaaaaacggactctccccttgtttccacattggcagaagccctgggatagcagacctcattgccgtgctggtcatttacattcagcgccagattgcggtaggcgccgatttcataagccctggcctttttcacacacagaaggtgcctgtccccggaaaacaccttgggggaatagcagattcttttttcaccgaaggggatggtatattcataagtatccgtcaggtaaaccagggattttcccagcgcatcatccacctgaagccagaggaagcagtttttctccgtggtctccaccaggattttatccccctcctcatatgcactcagcacggccaggctggtttcctcttccccgctgctcatgcattttacctgccggtctttatcgatcacttttaatgtcagcaagatttttccctcctaaatcaagaaaaacggcagaagccgcaacgatccggataaccggactgttgcggatatccggccatttcaaaatcgctgcgcgataggccggatgcttgctgccgccatgtttttatacgatacgcgtaactgtcccgcagcttaccctgaagcttgctgtgtcttcttgccgggactgtctgtcggggctataggctgcttactggggctgttttccgatgtaagccaggataccgccgtctacgtaaagtacatgtccgtttacgaagttggaagcatcggatgccaggaatacagcaggtccctgcagatctgcggtgtctccccaacgtgcggcaggagtctttgcaataatgaactgatcgaagggatgtctgcttccatcaggctggatttcacgcaggggcgcagtctggggtgtggcaatatagccgggcccaatgccgttgcactgaatgttgtattcgccatattcggatgcaatatttctggtgagcatcttcagaccgcccttggcagccgcataagcggaaacagtttcacggcccagctcgctcatcatggagcagatgttgataatcttgccatggcccttcttaatcatgccgggaattacggccttggatacgatgaaaggagcatttaagtccacgtcgattacctgacggaactgatcagcggacatctccagcatagggatacgtttgatgatacctgcattgtttaccaggatatcgattacgcccacttcttcttcaatcttcttaaccatttccgttaccgcttcttcattggtaacatcgcacacatagccgtgtgcttcgattccctcttccttgtaagcggccactcccttgtccaccagctcctgcttgatatcgttgaaaacgatggtcgcgccggcctgagcataagcggttgcaatcgcaaaaccgatgccgtaggatgcgcctgtaacgagagctaccttgccttccagtgaaaaatcattcaaaattcccatttttgtttcctccttatatgaaataaaattacatcagttccgtcattttaacgccgtccatgtcgtcgaaatcctgattttccccgaccatgccccagataaaggtataggctctggagccgctgccggaatggatggaccagctgggtgaaatcaccgcttcttcatttcttaccacaatatgtcttgtttctgtgggctctcccatgtaatgcatcacgaaagcatcctcgggaagatcaaaatagaggtaaacctccatccttctgtcatgggtatggcagggcatggtattccatacgctgcccggtttcagggaggtcattcccattaccagctgacagctttccacctggccgggaagaatgtatttgcagataactctgtgattggattcctccaggctgcccagttccaccttattttcatccttaatgatgaccacgccgtcttccggtgtgccttcccgcttaatcagcacggtggggtaggttgtatgcgcgggagcgctgtttaaataaaattttgcaggatttcctgcatctacgctttcaaagctgatgtccctggaacccatgcctatgtacatgccttctctggaagccacttcataaactctgccgtcaacggtaattcttcctgcgccgccgatattgataacgcccagctctcttctctgcaggaaatattccgcacgaagctcgtctcctgccgtaagctccagcttctttgcaaccggagttgccgttcccgtaataatacggtcaatgtggctgtataccagcttgatttcatctgccgggaaaagcccctgaatcaggaactcctcacgcagtctttctgttgtgtaatgctttacgtctctgggtgatgatgccgttcttaattccatttctgctcccttccgcccgcttcatcgggcatgcggctgcgccgcctgcaggcaaaaggccggatgccgccattaccgcttgcaccttcagccatttttgccctgttccgtcatttccaactgccttaaatgcatttatcatatcatgctttatattccggttcttgtgttattttctttaaaatcttgcttattctgaacttatgtcgtatactgtacaaaaaggatatttttcctgtaactatatgccgcagatttaccatagcgccggctgattttcaggaaaaacaagggttcttttactaaatcagagaaaggataaagcgaacacattatgaaagaatacagctcctgcaaatcagccattcagtcctgcatagagaacaaaagttttgcggtagcccacctgtataatgatgagagacctatggatatgcatatccatgactgctatgagatctattattccatctcaggaggcaagcagtttctcattgacaaccgcttctacgatattcagcctggggatattttttttattaaccaatatgaaagccattacctgtcccagattgatcaggctgtccatgaacggattgtcctgtcgatttatcctgatttcgttaaaagcatttcctcccaggcaacggatctgaatacctgcttccactaccgcggcagcgaggtttcccacaagctccatctttctgaagaggagcagaaccgtttccgttattttatacataagcttacgggcttttccggctttggctccgatctggaggaaagggccgtttttacagagctcatggtgttcctgaaccgtattttctacagcaaaagcaaatccggtgagctgccgcttgatgcagcggcataccatacacaggtggacgacattcttacctttatcaaccagaacattgattcccagctgagcatagacgatctgtcctcccatttttacctgagcagctcctatctgtgccgtattttcaaagctgccacaggcactaccatcaacaaatatattaccgccaaacgtattacggtggccaaatccctgctcagcaccggttattccgtcacggaaacgtgcgagaggtgcggctttaacgattacagcaattttcttaaggcctttacgaaggctgtggggatttcacccaaaaagtatgctcagtgttcggccagctgatgggcttattgagtgttctgcatgcggtagtaggtgcctttttgagccatcagctggtcgtgggtgccgcgttctattatttcaccttcctgaattacgagtattaagtcggcattgcggatggtggagaggcggtgggctatggctatgatggtgcgtttgcctgtgatgcagttgatggctttctggatctggcgttcggtttccacgtctactgaggcagtcgcttcatcgaggatgataatgggggactggcgcaggatagctcttgctatggccacgcgttgtttttgtccgccggagaggcgcagacctctttctcctacttttgtttcataacggtcgggcatgtgcatgatgtcttcatggatgttggcggcttttgcggcttcttcgatctcctcccgtgtggcgtccggttttgcatagccgatattatcggcgatggtgccgttgaagaggaacgtgtcctggagcacgggggaaatgttgcggcggaggctttggagagtgacgtttttaatatccttgccgtctatgagaatccggcctcccaccggatcgtagaaccgggacagaagctgtgtcatggttgtttttcccacgccggtggggccgaccaatgccaccatcatgccgggttcgcaggaaaaagatacttttttgagcaccggtattttattggcatagtgaaagctcacatcttcgaaggtaatgcttccctgggcctttcccagatcctctgcctccggtgcgtcctgaatggctgagggcgtatccagaatcagggtgacacgttccgctccggccagcgactgctgcagattttccagcagattggcaagtcctgaaaccggcgcgtaaaacagggagaggtacagcatgaaggcaacgatgtcttctacggaaagctgcccccggtacgccagcacgcctccgaaaaataccacgagcacagtacctacagaggacagaaattccacgctggggtggaatacggcgctggcgcgcagcgcgcggagcatggcgcgtacctgttcaaagtttttcttttttacctgttcgtcttcaaattcttcctggccgaaggactggatctcatgcaggccggaaaggttatcctggagcttggcattcagttcacccatgcatttctgggaagccttgaagaaagggcgcactttcttggcaaaaattacgccggaaaagagaatcagcggaatcgggcagcaggtaatcagcgccagcttccagtttatcataagaagaatgatgaggacgcccgcaaaggtcaccaggttggtgatcatttcaggtatcatatgcgcataaagcagttcaaaatccctggtgtcatttactaccctgctcatcagatctccggtctgcttatcatggaagaagcccagatccagatgctgcagcttgtcatacatcctgctgcgcaggtcccctaccaggtaccaggcagctttatgcgccagataattgcttaaaaaccggaaagctatccgcagcagatagagtcccagcaaaatcagcgtcagcttcgtaattatggagaaggacgtattttccagccccttttccactacgccggtcatggttgacagtaccttgggcgccgccagattcaccgcggtcagacagagcgtggacacgatagccaaaatatagagtcccttgtatctcgccgcttcctttgtcagcttccatagcattttcattgatatttttccccctttatctgttatgcctgttttgttttgatttatctaaaggatttcagattactattaagtataacgccattctgcattggtgaaaagaagaaatcagatttctttttcgtttttttcctgttatgcgtttttttccggacactgctcttgacggctgttacgccggcggatcggtattccggcagaaacaggcgggaatacttacttataccagcccggcttggggtgaaaagatgggaaaaggagagttttatgaataaaaagaaatatgaatttgatgcggtaattaaaaaggtccctgacatagacggcgcttatgtggaatttccctttgatgtgcggcaggaatttggaagggggcgtgtcaaggttcatgccctttttgacgggacggcctatgatggcagtctggtgcgcatgcagacgccgggacatattattggactaaggaaggatatccggagcctgattggaaaacagccgggagatacggtacatgttgtgattacggaacgggaatgaaagggataattttgttatctctcccattttatccgttatgtgacatcgtcacggaagtttacgcatataacagttaaaataagaccatgaagtaaaaacacccgtaactgttggggttcggaacagttatgggcacattaacaattataagcgtaaaaggagtgaatgatatgtcagtaacaaacatcacatcagacaattttcataaagaggtacttgagtccgaaaagcccgtgctgctggatttctgggcgccctggtgcggcccctgccgcatgttttcgcccacggtggattctgtggccgaggagcgtgaggatatcaaggtcgggaaaatcaatattgatgaaaatatcgagctggcaaaccaattcggtgtggccagcatccccactcttgtcctcgtgcagaatggaaggaaaaaagcggccagcgtaggccttcgttccaaaaaggatgttttaaaaatgctggatgcctgagcggctgcccttgcaggctcccgcccgtaggtcatccagtcatgatgtgctttcccgataaatcaaagccttgctttgcagccggtaaaaggctggaaagcaaggtcttttttatctttgaagcaacacgcctgaaggctttttattttccccacttgccttccagcgcctgaaattcctcttccgtcaggttaagcacgctgccatgtctctttttgctctttcccaaatcgtattccgattcttccgggattctgaactcgccgcttccgaaatccgggctgaacaggggaagatagccttttccctccgcaaaacgatccacaaggacacaccattcctctctgtcgttaaaccggaaggatgcgggtccttccacgccggccagcgcgttcagcaccggcgcatacacctccgtaaagctgtccttatccaggcttctgcttttttccaggcggatatttttctcggtttcatctttggagaatctgtaataataatccccggcttttaatatcgtggtgtcaatgatatggttttcaccctcctgatatttgacaggctccgtaaaggcatggaagtccgtcgtataggaagcgtaaatgcgctgctttgattccgtgtcgcccggttccttcaccttggaagcccagaatacaagaaaggcctgcttcttttcatcaaaaattgcttccggcgcccagacgcagccggcctccgggattccaacctccgcgcagaacgggccgtcccagttcaccatatcctccgactcccacacaatcaggttcctgctgccttcttcctgtgcagccgtccagccttttcccgcttcgatccgaagatccgtagcgataatcacgtattttccgttcagggggttcctgaggataaagggatctctcacgcccgcctctccgatatccgaaaccaggaccggctttccttcatttaaatccatccagtgcagcccgtccctgctcagcgcaaaataaatctgctctcccagcttttcctctcctgtaaaatgtacgaacaaatatcctgtgtatgctgccataattcttcctttctctcatgccgtcaaagcggctgttgctgtttatactttttattaatataggtacaggccgttacagcccgtattttctgtacagccggctccgcagggatgcgtcctcagccacacgcaggatgtccgtaaagcgttcttcctctcccagccgctgtatcagctgcgccaggcggttttccccttttttcatcccacgcctttctccgcgtctttctcctcgtctttctccgcgttcctcaccgattttaattccttccttacggcagtcgtccatccattcgtcaaaagctctgcacatatcgatgcgtcctccttccctgttttccctgatatatttctccagcctccgggaattggtgcagtttactatcaccgcgaatcccctttctgtcatgcgtgtgaaggcatccctgttggaattcacaaaagcgcacatggcagctttatcatccactctctgcaaaatacccatcacctcccgcagctccgtacggaacagttcgatatccaaatcctttcttatcgagagccgccgcaacgggtaatccggcaccatatccaacagccattgggcggcgcctccgaattccagcagatcatgcagcctgtccggataatcccattcggcggcgccataatacaggacgagcgtaaaaaccggaatcagacggtcctctttcccaaaacgggaaagccctgccttttctttatgtactgcggcaattgcctttatctgccgctcgtattcatccgcatcataacgcatacagcgtacaggcatccggcagtccgggttctcctggttttctacagccagcactgcggccggacggtgtctgtaaaacagcttctttgtatcccgaatcctttttcccggctttccgctcctgctttcggtgccctgcacgctgtccatgggcagaagctcctccgggcggatttcctgtcttccccggaaaaagcagccattgagcagatctgcaaagatatgcggatctcccagaaattcattcagggtaatgtcttttttccccattcgtttctcctacatattataaacttttgtgcgtgaaatatcaatcatttttcagttgtgatccagaggttacaaaccggaccgaactgttacagttcagcctggccgccctgtaaccgcatcaaaaaaatgatttcttttgactggcttatgcctggggaaacacctgagagagctctcgggatttttcaagattaactcacttaatttcgtttatgatatagaataacaaaatttgtgggagagggcaagttttttcaagcttttttacttatttttaactgtttcgaagcaggatgtcaactgcaaccctgaaagcggcagggagcataactgacggttctgctccctgccgtaaattttgattgtttactccgccgtaatcgtcctgctttccctttccgctgaaatttcttccacggttttttcacggattcttacagctccctgatatccaacttttgtaggaatcagatcgcctttggcaaagcgttccttggcctctgcgatggcctgggtatactggggcagccactccgcttccgcgatcagcatttcatctatcatctgccagatttccggagggttgcacacggctccggtcagaggatccatgagggcggcctgcttcagaagcttcacatcgcccgccaccgctgcttctacggccagacgctgtacccatatggactgggaacaaacggcggcacagcccaggggcagatcccccagcttgggaacggagattccgttgccgtccacatagcagggaacttcaaccacacactcataaggcaggttggtaatgcagccttcattcatgatattaaaatggcccctgtattttctgccggtttccagggactccatgatgtaggagcagtgctcctttcccctctggctgccgtcgtattttttgggaggctctgctgcaatcttggggtattccgtttcaaaccagttgcgttcctctctggtaacgcgcagatagccgccggtttctccattgatccagctgtccgtattgatccagtccttgatttcatccggacgcttccggtaccatgccacatattcggataaatggccgttggattcggtggaataatagccgaaacgtttcaggatatcaattctgaccttctcctcttcgctgaagcgttcatgggcctcaaaaccggcaagcagcttatctttcagctccacgcctttatgctttacgctcacataccaggtctgatggttgatgccggcgcaggtgatgtccagctcctccctggggattcccagaacctcggcaatctggctctcgccgtgaatctcaccgtggcacaggccgatggttttgaccccgccgtatttattgcatgcccaggtggccatggcgttgggattggagtaattaagcataattgcccccggctccgccacttccctgatatccttacagaaattcagcatttcagcgataacgcgctgtccgtacatgatgccgccggtgcagagagtatcgcccacacactgatccacaccgtatttcaacggaatgtccacatccatttcaaaagcgggcaggcccccgatgcggacgcagttgataatatatctggcgccgcggaaggcttcccttctgtctgttgtggcctgaatggtaatcgggatattgttgctgtccaaatcccgctggcacagacgggttaccttatccagattgtccggattgatatccgtaaaggccacctcaatgtcatgaaattccggtacggacatgatatccgtaaataatgtcctggcaaaaaccaggcttcccgccccaatcactgcaattttaaagctcataatacttcccctttcctgatgtcagcagtatcgctgttcatgtgcaaaaacaggaatccggatgaaccacataaaataacgggttccttcctccctgcgctgtttttacagccggtccggcaggcgttcacctgccgggcaattgccttattcccttattttcaggctctgcggatacagaaaagcttcgcgccatgtgccttcacaacgctggaaatcacgcttcccctgctttgctgcacttctccggtccaaagctcctccatcacaagctcctgatccaaatcaggaacctccgcggatacggcggcatacacatcctccgtctttacgccgacttccttttcttcatcgttgaaattaaacagcgcggcataaacggcatcctctccgtttttcctgctggcccataccgcatgcacgccgtcccgttccacctgtacgccatggtactccgatcccataagcgccagcaccctttcattggtgagcagggaaagcgtccattcgtccagcttgggcatttccgcgcccagcatcaggggcgaacggaagatgcaccacagggtcatcatggtcacctgctcttcctttgtaaaattggtctgcctttcttcaccgaagcccttgcccagccagcccaacggcagcatgtcgcagtccggatagcagccctgtgtcacgtggttctgccacagctcgcagcggtagaacatgttcaggagaagttcccatttatcccagaaatcatcggtaatacgccacatattggcatacttctcataatgccatgccttctcaatcagcgcagggccgggagaaagactgagaacgatggaacggccgcatttttcaatggccttgtggagcatttcgatctcatgggcggccgaatactggttttcccgataaatactggtgttgcagatgtcgtcacatttgatataatccactccccactgggcatacagcgcaagcagggaatcgtagtaagcctggctgccctccatatcctttctcaggccgtacatatccggattccagccgcagatggaagaaggattggcaacctcgtccgctgtctggctgcttcccagcaccggcagatggttctgtgcggccgcacggggaatccccctcataatatgaatgccgaatttcaggcccaggccgtgtatgtaatccgccagaggcttaaagcccgccccgtccgcagcggaagggaaacgctccgggcagggaaggagccttccgtattcatccatttccagcttgctgaaggggatatactgatgcttatcgcgcatgcttcccgccccataggcataccactggatgtccacaacgatgtactcccagccgtactgcttcaaatgagccgccatatagtcggcattggccttcacctgttcttcattcaccgtggtatcatagtagtcatagctgttccagcccatgggcggcgtcatggcaaacctgtttttatccattatcaaatcctccttgttttgcggagcaaaatgcgagccctctggcgagcagaggattttcctccttgttttgcggagcaaaatgcgaaccctctggcgagcagaggattttcctcctaagttttgcggagcaaaatgcgagtcctctggcaagcagaggaattttctcctgcatggtatttttttgacaccggaaattattgttctgttttcattgtctttcctgtctgacttgattataatattcccatattgacagcacaagaataaaaaaacgataacggagggtaattttttgaccttacaaacttatggaaccttcggcttcctcaatccggggcaattggcggaggaaccgcttatgcttctggatttcggtatcgaaaaaaggcagtccgagaagtatgatttctataatgacgaccgggattatgacggctttctgtttcagtatacctttcagggggagggggtttttgagacggaggagggcagccgcaggctttccgccggcaccgcctttttctcctgtatcccggaaaaaagcaggtactatctgcctgcgggagaaccggaaaaccggtgggaatatctgtatgtgcattttcagggcccggcagccgttccttttttccggaaaataagagacagcttcggcccggtagttacggttcccgcggacagctttccaatacagctgtggctgaacctgcacgaggatatgacaaatggccggcagctgcggcggtatgagggtggagatctggtttaccgctttctgtcttcgctgctgcggaccctggaggaaccgcagcggcctgcgctgacgccctgtgtggaggaaagcatccgctacatgaaggagcatttcccggagcatttttccatagaggagctggcggcgtacaaggggctttcctccgcctatttcacccggctttttaccagggaaaccgggcagtccccggtcagatatctgaccgggctgcggctttcccatgcgctgtccctgcttctgaacaccaccatgcccgtggaagcagtggcccgggactgcggtttctcctgcgggaattatttctgtaaggtgttccgcagggcatccggctgcacgcctgccgaataccggcggcgctatgggggctgaccggctgcgggcgtcacacttcctccctgcaatgcctgttttttatgccgcacagaaatggaagtcgctaaaagataaaaagaagcatcttatctccattgttttccggcagattttatttatacttggttagagcgtgattaaaaattacgtgggaaaacggcggataaaaacactgccgccggcatcaaataaggcctggccgcagaaaggcagctaccagttatcagcagcggacgggcatgaaaaaaacggaggacagatctatggacagtttgacgatgaggcttgaagaaaattggaaatttcaccttggcgaggcggaagacgcctggtataagggttatgatgacagcagctggcgcgacgtggtaattccccacgactggtcagtggaacagcccttcagccaggaatattccagcggtacgggatacctggcaggcgggaccggctggtaccgggttcgttttacactgccggaggaataccgggggaagaaaatctcactgctgttcgacggagtatataaaaacagccaggtatggtgcaacagctattacctgggaaaacgtcccaacggctatgtcccttttgcttatgacatcagcgaaaaggcctttttcggggatatggacaatgaggtaagcgtgaaggtaacccacacggatgtggcggattccagatggtttacgggaaccggcatcacacggaaggtgtgcgtccttgtggaagaggcggtgcatcccgtacagaacgggatcttcttttccacgctttacggtgatgacggaaaatcagcccaggtggaggtttcccatgaaatcgtgaacgaggggacggataaggccagtgtttccctgagcagctccctttgggacgcagaagggaaaaaagtgctggaggtatcttcctgtgcggagtttgccccgggagagaaaaagaccatcgctttaaacggatgtgtgaaacaccccagcctctggtccccggaatccccttatctgtaccgcctcaatacggtgctctccgtaaacggggaagagggttacgaagtattttcaggtaaagtgggcatccgtaccttccgttttgatgcggataagggatttttcctgaatggtaaaaaccggaagctgaagggcgtctgcgtccaccatgacggaggctgcctgggagccgccatgacaaaagaagtctgggagcgcagactgaccgcgctgaaggaaatgggctgcgatgccatccgcaccagccataatccccatatgccggagctgtacgatctgtgtgatgaaatgggcttcctgatgatggatgaggccttcgacgagtgggaaaacccgaaaaacaaatggtccacaggacataatgtgtacccgcccaagcatcagggttactttgaggatttcccggaatggcatgaaaaggatctggcggccatggttttaagggacaggaaccatccttccattatcatgtggagcatcggaaatgaaatcgactaccccaatgatccctactgccatcctttatttggagaaatgacgggcaacaatgacaaaaataagcccgccgcggagcggatgtacaatcctgataagccgaacatggaaaggctttcgcccatcgcggcagagctggccggcattgtaagacagtacgattccacacgcccggtaacgctggccgcagcattcccggagctttcctccaggctgcattatttcgacgcgctggatgtggtgggctacaactataaagagcatctgtatgaagaggatcaccgccgttttcccaccctgcctttcctgggcagtgaaaacggacacagctatcaggcctggaaggctgtaagggataacgattatatcagcggccagttcctctggaccggcattgattacctgggagaagcgcacggctggcctatccacggctcctccgccgggctcctgacgcttgccggcttccccaaagcacgctattaccgcagaaagtccttctggtcagaaagccccatggtatatcttgccacggtaaaatacgaaggaaaccacgaggaatggatgcctttatatgaatcctggaactatgaatccggcgataaggttctggtccgcctgttcaccaaccagcctgaagcggagcttttcctgaacgggaaatccctgggcgcccggaaggaactggacggggacggctgcatggaatggatcgtggattatgagccaggcgaactgaaggccgtggccgggaagctttccgcagcctccagtgaaggctgcgtaagctttaccctccataccacaggggatgcggcgaagctgctgctttcccgctggtgctccgcacgggaaaaaggagaaaatgcggatggccttcaccctgtttatcaggtggaaatcacggttgccgacagcgagggatgccgtatcggcaatgcggactgccttgtagaggcgcaggttaccggcagcggcgttctcctggggctggaaaacggtgatctggctgacaatacgccttattccgattcttccagaagggcacacgaaggacgcctcatcgcttacatacgccgcacgggagacggagccatcactctacgcgcccacgcggaaaacctgcccgaagaaacacttattatagaagaaaatgcctgaagctgacggaatcgaggaaatgacagaatatggatactttgaccgggcaaaaaaagatctttcaattgtatgacaaatccctgagccggattgaaacgcctcaggggacgctgacgctggtatcggtgtttctccccttctttgtagaaatgctgcttaccaactccatgggaaccgtcaacacgctggtgctcagccactattcagatgaggccgtggcatccgtaggcgcagccaaccagctgatgggcatgatatttaccttttatacggttatcagcaccggcgccagcatttttatcagccaccggctgggggcaaagcagaaggaggcggcttcggacgccgccttcacctccatattctgcgggctggcgctcagcctcgtggtggggaccgtgctttccctctttgcccacaggctgatggaaatgatgcagctaagcggccaggtgctggaggatgcggcggtttatttccggatctgcatctccttctcctttttccaggcgctgatatcttccatttccgccatcttccggagctacggcctgccgaaaatagcggtctgggtatcactgttcatgaattttctgaacgccgtgctgaatgtaatcgttattttccggccgtttgaaactccgcttcatggggtcagcggcattgcgattaccaacgtaatcagccgcggagctgcctttgtgctgattgtggtatgcctgctgagaagctccctggagctaaacttccgtaaaaagaacctgaaaacgctgaaatgcatcggaaatatcctacatatcggtcttcccggcggaatcagttcactttcctattccacttcccaggtggtatccacctccatccttgcggttctggggacggcggccatctctactaaaatatacctgtccaccatattcttttatgtctatgtgatcggtatgtcccttggcatggcgacctccctcatcatcggctggatgaccggagcaggggaatatgataaggcttaccggctgaacatgcagaacctgcgcattgccgtactgctaaacgccgccggctccaccctgattttccttttcggcggaccgttgatgggcctgtttacagacagtgcggaaatcatggctctggcacgtcccatcctgtttatcgatatttttgtggaaatcggcagggccttcaaccatatcgaggataactccctgcgcggcgccggggatgtgatattctccatgatcgtttccattatttcctgctggaccatgagcatcctcttttcctatattctgggaatccggctgggactggggttgacaggctgctggattgccttcatgatggatgaactgttccgtggaatcaccttcttcttccgctggcggtcgcggcgttggacgctgcggaaggtataaccgaatcggcgtaaccggatcaggcattttgatattaaaaagcctctgtcgttttccattacggcagaggcttcttttgtatttttctttgtttaccttttattttcttagattccatttcttctatcatttttctgaaatctgaactgtccctcagcgttttcttactcattttcaatacgtaagagagaattctggtctcatactcatcgcaatccttaagcagctctatatatcctcccggcagctggggttcctttctgtctggctcgtcatagagaagttcatccacagatacatacagcgcattggctatatttacaatgatctccagactgggatttccgagtcctgattcaatccggctgacatataccggaacaataccgactgcatcagccagcatttcctgagtcatgtccgccctgattctggctatcttgatccgttttcccatctctttcttctccgcctgcgtcagctgcttcttttcccctttccttcttcccattccatttcttcctctccaacagctttatagcttccgtatagtcctcgtccatccgcagcgttgctttataccattttaaaatataaagcagctgacgctgttcgttagcgctgcagtccttcagcgtatccattatttcccatctgaacactctgccggatttcaaaacactgtcacacagaagctcatcattccggacagaaagagccttggaaatactgcataaaacagccaggctgggcctctcatttcccgactccaaattcgatatgcgggacggttccaccacagccaatgacgccagcttttcctgaccaatttccatcctgtttcttgctgcttttattctttcaccaagcgctttcgtattcaccgtcacaaagaccagcctcctgcattacgtcttatatgactcattgtaaccttagatatagtatattataataaactatataattattttattattatagtatagttatttaatccgtaataaaagattgttttccgggaatgcttatatagatgcgcgctgcttacaaatttacataacataataaacggggatcttttttctccgatgaaaggaaaaatcatggaatttgaatcggtagaaatccgcaggctgctggccgcgcttacggaacgcacccggaaagggacgattagctgggaagtggcggaatacgatcccatctgctttatgactgaaatgggtgtggaatttgatggctcggagacagaaaattttgcccagaacatcgccttttgctgccggctgaaaaccggccgctccatctggctggaggcctatgaatccataggcttcccgtctccccgcggctttccctccccatcggccggacccgccctgaggggcctggggttttacatcatccgtttcctctccccttcagggaaggtgctttaccagtcggaacgtattgtgaccaaaagagagcagcagcttctcatatgtcttctctgtgacgctgtttttcagaatacggagccttattttctccatctgccgcacaataatacggcacagttccagaaatacctgcaccatcatgatccgggcggcggcctggagggccatccgctctcccagcttatgaaaaaattttacagggataaccgctgtctggaatttcatttgctggccataagctgtgccaacggaatcaaaaacgggaaatgacgcattctgtcatttcccgctttttctcccgttcaggccttccctggcatattctgtgggcgattttcccgtatactttttaaaaaccctgctgaaatagtattcatccgggaatccaacgctttccccgattttggacattttccagggggaattgaggatcagagccttggcatggttgatccgcacccggttcagatacctgaaaatcgtctgccccgtcaccttcttaaaggtacggttcatataatcaaaattgccgccgaattccttttccagaagctgacccgtgatatccccggcatattccctgttcaggtaattcagcatttcctgtacattccggtaggatcggggctgctcctccacataggcaaccgtctccgtggatacatagcttctgccaatttccacaaaagcctccagtatcttacaggccagcatggttttataattctccagctgtgtcgtgttattttccaccgcctcattcaaaagctctgtcaccttaacaagactgctgtaatcggccatatggtaatgcttcggaagatacaggctctggccttcgcacttttcatagctgaaaatatcactctggatcgactcctgcctgttctccagcagaagcttctggaatcccttttcttcttcaaagggttctatttcaggatgcctgaaatgtacgtaaaaatactcgcaccaggaggctttcactcccacatgcgtaaaccggggatccagtacaaatacatcccccggctgaagggtaaccgcccgtccgtcctcctccagatacatgacgcccttcttaatgagataaactatgtattcgtccgcctttctcctccggtgcacgtaaggcggttcaatcaccaccgaatccgccagcctgaccgatggcagaatccggggattcatccggtaaaacattccctgctgtctcccttcctctcacccctccgggcataccgccggccagcccggaaccggaaatccaatacttaacgcacctgcttacaggaatcccgaatcaccagcctggatttcaccatctgtacccgcggcggctcctcattgtggatagcctgtatggcagtttcgatcagagtcttcccgaacagcttataatcgtagccgacacaggtcagccttggcatacaggtctctgcaatataagtattatcaaagctcaccacggaaatatcgtccggaatgctgtagccctgctcccgcagcgcgcggacaatccccacagccgtaaagtcattgatggcgataatcgcactgggcatgggatgatcttccctgataaagtgatacattgctgcattcccactttctatgtcataactgataccatccacaatatattcttcccgcacaggaatcccgtatttacgcagtatctggcggtaacgaagacgcttatccaaagttgattttacattatcacggccgccaatcaacgcaatatccctgtggccgttttcaatcagaaattgcatcataagttccatggactgaccttcatcaagattcacctgataacagtcagcaccgtccagttttccagtaatcaaaaccggtgttgtattggcaattcgattgatattctccacatatctggtatccgataccagttcatcaacttttcctccgatttgaataatcgcatccaccctttgtcctgaaaacttttccaaataagatacttccatctcattacttcccagggaattacacaacataagcaggtacccattcttattggcctccttttcacattccacagccatcgtagcatagaaaggatttctgatatcagaaaccatcaggccgatgattttggtttccacactgcttaatcccctggccaaagcattgggcctgaaatcgtatttacgtattaatgcctgaactttggatttcttatcctcgcttaccttcgcgttccctgtcaggactctggaaaccgtagcgggggatacccccgcttcctttgcaattgtatagatacttatagtctctttttccataacacgcctcccccgcttcttccccccgcatatagtaactatgtcaatgaaaccggtatcattatattttattataatacataccgcggaataaaccaatctttttttaccaaaaatcggttttgtgcaaattttatacaaaatttgcactttcacagccaatcagtacgatttaggataagctcatgagtggagtgtcattataatttctaacctacatccggttcggccttcagactgatttcatccgcagccctgccatctgtttcaaaaagaataatttcattaactccttttttcaatagcggcgctggtatatagaggcgtttctgaggccctatctcccagaaccggcccaaattgaaaccattaaggaatgcacaaccctttccccagcctgcaaaatccaaaaatgtatctcccgcttcctccacttcaaaggtaaaacgataaaatcccggagttccttccttatatcccttagtaaaatcaagcttatccagattatccaaaggcaatgtatacatatcccagttataatgcatatgcccgtttaactgtacgcaaccttcaattccctttctctgatactccatacgaggcccgaaattgacacggcccatattttctatcagaatatccagtggagctccggattcaaaatccacatttacctgggcttctgccagtaattctctatcatataacgtaatcaccggtttattatccacaaatatattcgccctgtcattcgctccccatagacggattttttccagattctgttctctttccaaagctgtatggtaaaggatataaccgtagctttgatccagcttttccataggaatcggaaaagtactctttacgggaacagaaatatcctcaagtacctggaacaatccgaccttctcctgtactttcagaattccataatccttctttttaatgtccgtagtaaaagcaactgtcggaagctgcgtatgttttccaatgatttccctgtatttttcatatttcagggtgaaatcgccggcttccgtaagcactgcgtcataatcataactggtaacatccggcgtcagttcatcataatagtttgagccattcataaaaccaaagttggttccgccttcaaacatgtaaatgttcacatgccccagctccagcatcctgtccagatccttcgtactttcttccagattaccgcgcatatggccaccattgccccaatgatcaaaccaccccacccagaattccgtacacatcagagggccgccgtccgtatactttttcagcacatcaaagcgctcctctgtttttgaaccgaaattgccggtgggaagcacgccctgcagcctgccgcaggaaagggattcatccatggggccatcagaggttacaaggggtaccgttacaccattttccaacataatctgtttcatagcttccatatacttggtatcgtcaccgtagtagccatattcattttccacctgcatcagtattattggaccgccgtttgtaatctgaagaggtgtaagcacggggaacagcaccttgtaatattcacgaacagcatttaaaaatggctcatagcaggctctcagacgcatcccatcttctttcagcagccatgccggaagtccgccaaactcccattccgcgcatatatacggagaagggcgcacgatgacataaagccccagttcctgagcaagcaggataaacttttttatatccagcataccatcgaacctgaactgccctttttggggctcatgcatattccagggcacataggtttccactgtattagcccccattgctttcagtttttccagtctgtcacgccagtactcaggaacaattctgaaataatgaatagctcccgatatgattttgaacggttttccgtccaaataaaaatcatccctgatttcaaaaatactctccttcattccctctcctactccttttccaaaagtcaatatttttcaatctatctgagaataacatcggttattgaattttccactccattatacataaatttttaattatatgtatattaaaataaatattatctgaataattgatgggatgatacaaattttgccggctgcatacccgatatacagccggcaaagtttttcaggtattaaatcttatatcctacttataaaccgcatctacctgtttctgtaattcttcaagaactgtttcaaagcctgcactctgtaatgctgctctgtattcagcaacgatatcttctgcgctgccatcatatttaccataagaaatcttcttcatgtagttatcatgaatttcattgatgttattgatattggactggatagctgacagatccggtaccagtttaccataaggatagtcaatctttaccttatcatattccgcacacagagcttcatagcttaccaggtctctcttgccgtccgggatttccagatcgtcgtttctgccccaccagtagttgaaagcaataccttttccttcatctgtatagccttcaggctgctgtcttgtacctgttgcttcatcataaacatactgctcgccttccctaccgtagcagatcaggtgataaacttcttcattgtttctcagataatcagctaccatcagcgctctttcaggattcttgcttgctgcagaaatagccattgcgccatgggtaatgttaagagctaccaggttgcccgtttcttcgccgaaccagaagaaaccaacatcagaaccaggctgttctttgtccattctgggtcttacagtaccataccaggtctctgtatggtgctgatctacggaagtctgtccctgtaacatttcttctctgttatcaacaccggtattgttcagaacgtctgtcttccaaacaccgagggtatcccattccttcatcatcttagcgaattctaccagttcatcgccttcatagaaaggagaccagagagtataaggatcattggtgcggcctccgtataatgcgcctgcacagataccgtcaatggagatgaagtctgtgtgggatgccatccatccgcctacaagctgaacgttgtgtgttccgtcactgtcccaaggaaggacatcaggatgtttctcttttacgctcttgaagtaggttgtcagatcttcccagctatgtacgccgttttccagacctgcttcttttgcccagtccatacggtacataaagccgtggttggtccactgagtaaagtgatcttcagggaggaaataaatttctccgttgtatttacatttatcccagttctctgccggaacctgcgcataggttaaaggtgcataggttttcagcatatcctcagaaagttcaaggaatgcgccctgctgtgcgttaggccatgcatccagccagtcagtacctgtacctaccaggtcaacactaccgtccatctgtgccagtgtcaggttgtagttggaaagatagtctgtccatccaatattgtaaacttccagcgtggtattgatttctgattccagaatcttattgatttctgccagagccgcttcctgctcaccatttgtcttggcatcacctacggtcatataggtaattgttacatgctcagaggtatcgattcctgcatacgggttattgggatccacctctgcatctgccgcttcgcttcctccttctgacgcttctgtagaagctgccggagtggttgtgctgccgctgctgcttccggtttctgtgctgccgctgcttccgcacgctgcaagagacattgtcatgacaccggttaacaggagtgccatcatttttttactgagtctgctcatgcttacatcctcccttaaaatttaaataatttttatatgtgaattccttctgtgtggaattgtcaccttagataaatcagccctttactgcacctacggtaataccgccgataaaatacttctgaacgaacggatacaggaaaataataggtccgcaggataccattgcagttgccattttcagtgtttcggacggaagatccgtcagggttacataggttccggccacagagttcttcagactctgtactttatttacaacttcgtaaagattgtactgcagtggcttataggttaccttggagcttaagaacagtgaagactgataccactcgttccagtagcccaatgccaggaacagaccaatggttgccaacgccggcttcaacataggaagaatcagggaaacgaagattctcatatcgcctgcgccgtctatcttgccggattcggtgatttcgtgagggattgccttaacaaagttcttcatcaggataatcagccagggtgacatcagcagaggaagaaatactgccagatagctgtccttcagatgataaaactgtgtcattaccaggtaatagggtgcaagtcccgcctggaaaaggcttgtaaaataaatgtagaaagaaatagcattcctgtaagggaaatcctttctctgcagcgcatagcccgtcatggcaatgatgcttaagccaacggccgtaccgcataccgtcattaaaattgttacgatataagatccgccgattgttccggcttttaaaataagttcataagcataggtggtaaattccttgggaattaactgcaccccttccacacgcacaatcgcttctgaggtaaatgaagttcccagaataatcaaaaagggaaaaacacaggcaattgcatagatggtaactaatatgtatcctaacgtacgaataatcttatcggaaatatccaatttaattttcgtcccgttcattgatttcgtgttcgtgtttgacattctaattctcctcccgtattagaataatgaataatccggttcaattttcttaaccacaaagttacaaagcataaccagtgcaaatcctatgatcgactgataaaaaccaactgcggatgcggtagagaaattaaagtcggtaattgtcgcacgatatacgtaagtttcaataatgtcggtggtcggataaaggatggagttctgtccgattatgttgtagaacaaaccgaagttacctcttacaatgccgcccagtgcaaacaggagaaggattacgatagtaggacgtaaaccagggataattatgtagcggattttctggaaggcatttgctccatctaccctggccgcctcaatgatttcagcatcgatgcccatgattgcggcgaagtatactaccgagttatatcctgtgttctgccacagatttaccagtacaatgaggaacggccaaactttaggattggagtagggtccccatttctccatgcccaggctgctcagtacagagttcacaaaaccgtagtcgtagttgagcatgttgtaaacgagcagacctacaagaacctgagaaataaagtaaggcaggaacatcattgtctgggaaaccttcttaaaccatttgctcctcatttcattcaacaggatagcaaggaaaactgctaccaggttgcccaggataatgaatgccagattataaagaaccgtatttctggttaattcaaataatttacccgatgtctgcaggaacttgaaattgtccagtccaacaaaaggactaccaaaaatacctccacgataattgtaattaacaaaggcaacatagatacccggcagcggaatgtagttaaatgccagaaagaataaaattgccggaagacacatcagaattaagactctgtaacgtatgatattctgccatacagttctcttctttcctaccgccttaactgcggctgcattttttttagattttttcactctttttccctcctgttgctcctaaaatactgcccaaaaatcggagcctattattttgaaacccatttcataactagattatatgcaacttttttccgcgcgtcaacacttttcacaaaaaaaaaaaaaaaaagcactatttttgtgcattcagtataattttccatttttatcattgttttacgcaacctatttttgtgtattttttattattgatttttatttaagttcaatattaatctatatacagttcatattcagaaaccgctttcaccggtttagttacaaatataattatttattacaccaggttatcaacgacatattaaatgaaatcatttgaatacaatacaaaaaaccggcattccaaaatttgaattaccggtttttctctatcattttgagttctttctatttttttatgtaatgttctttatacttttacaaactacattttttaagtttagcatttacaaacctatgctcttataaacctattttctttaccagtactgctcccagtccttcgccaacctggtcagagcctccatgtagaaatagtctccccaggaattgcattcatccacgccgcagtgattgcaggtattgtagggtgaatgattggagtaggtgctgtgaagcaccaggccgttggagctttcatgatccttcacggcataattgtcatatatcgacttcataatctcagatgccttccggctgtaaaaagcggcatcctcctcaggcagatatttagccatttccagcataccgcaggctgcaataacagctgccgaggaatctctgggctgatcggagccgtctgtaaattcaaaatcccagtaaggcaccagatcctccggcagatgtgacaggaagtactccgtcacagtgcggaaggcatcaatatatttctcttctttggtataacggtagcccagcgccgttccgtatacgccccaggcctgtcccctcgcccaagcggagccgtcgcggtagccctggcaggtagcgccatgatccggttccccggtttccatattgaagaagaaggtatgccaggtagagccatcctcacggattacattggcaagggcggtatggatatgcttctcggcaatgtccctgtatttgctgtcccctgtttcctccgacgcccagtaaagaaggggcaggttcagcaggcagtcgatgatcagacggtagttttcaggcgcgttcatggctccccaggcctgaatgaattcccctttttcatggaaacggctgatgagctggtctgccgccttgaccgccgcttcttttcccagttcatttcccgtcagcttccaggccgccacgcaggagggtgtataaaggaagcccatgtcatgatgatccacacaaatcttattatcaatgcggtgaaggaagtccttcacctgaacctccgctgcctcgcggaatgcctcattccccgtatgctcataggcaagccagatttcacctgtccagaagccgtcagtccagtcgttattttcaaccggttcataaaaattgtccacactgtaggcattctggaatttatccgtaaactccggcagatatttcaggatctgtgctgctgaaaagtccaacgcctgcttaacctcttctttacttatttcctgatattccatattctgctcccttctgcgctgaaagcgcccgttaaaatactgttacgtttttacgcccggagccggcaggccccttaataatgtatcggttcgatatcctcaggaaccctgtcccacgcagcctgttctccggcagccacccggtacattccttcgtggcattcccgcatggcctgtgtcatatccgcatattcctgcatgcatacgtctaccaggccgatctgatagttttccccgtcaaaacggcccaggcagctctgatcgttgagctggaaataatgggctcccaggaaatacggatttgtcagtccctgctccacataatatctgtaagcgcagcctctctccttctgtgtggtaacaccgcggataccatgggctgtcagccctttatccagcgccccctgatggaattctcccaccataaccggcttatccagccagcctgacacctgctccacaggctccagcggggtaatctgatagctgttgatggaaaacacgtcaaaattctccgaaccgcatagcaggcttttatccgtaatatatgcataacgcattcccagattaagatggttcttgtccaccttgcgaagctcccttgccggaatctccacatatctggttatcatctcttcagaaaatgcctgcagatccgctgccgcccgttctgagagcgaagccgccttatagattccctttttcagttcctcaaagctgtccagttccagcccccatgcctcattaaaggcggaaacctccccataacggcgctccaaacgttccacaaaaacatccttgctcactgtctgcgccggattggcaagcatttcctccgcgatattcaatccgtaaacgaaagcccaggcaggctcatttctcataaaatatccgatcagatacggatcctgtgcaaaggcctccagccctttcgcatatctggccgccgattcctcataggcaggtgaaaagacatccggaaaatcccggaaaatggcttccggcgtatgcgggaacccctcttcgcagaaagcatccataggaattacataaggcatgcgtgcaaaacggataaactctctgtcggaccagtttccaatggtattgacaccccaggaaagcagataatgctttacaatcttcatccagctttccttccagccctcaccgaaggccgccttcagattctccgttccgaaattaaagaaatcctttttatcatgggacatggcaatcgttccaggcctgtattctgcgatttctttgcagccctttgcagcctgttccccaacgaaatcccgcaccggccccacccgggtttccacaccgggattaatacagtccagccctgaagagaggaaagcatttccttgcggatctaccagccagaatcttccgttttccctttccgtatggaaccatcccgtcttttggaaggtctttcccttccagccgccgaattcgtcccagtctgggaacggaaaatgatccccgctggtttccgcctcctccagcaatgcccgaagccgccttgtgcattcctcccggccggacagctttccctcccagtccttctgcgtccactgccccagctcgtcaatcagctgcttcttctgcaggctgcagtcaggaaaggtatctgtgaaaaagcattcatccgcagcgaaatggaaggcctcaaagccgggcgccgtctgcagccggatctgtccgatatcgcacagccttaccggcttcccgaaaatgctcatcttcaggcgccccggcgtacgctccggaaatatcacctggctgtccagtatccggaaatcaaagggcaccatcgtttccacctgaggaagcagcccaaaaataatgcgcatctgaggctcctgagccggcagttgatgcccctcttctgccggattctcataaaaagaaagctggaagcacatggaatgctcttcacatacctccggcttcaggcagagatacgcaaagtcctccagccggacagatctgtcatccgctctggaatacaacagataatcaagcccctcctccggacaggtaaaacaggctcttccatcctcctgccagtccatgctccccctgtacagcctggactggttccattccagcgtatgccggatttccccttctccggcgttcctgctgtcataattcatgatttgacccccttatcagagtttaaagtgaaatcggtttcaccctcattataaaagcaggaaaacaggatgtcaaatagtaactgtgaagttactgttcactcagtactgtgcatttactgcacagtacgtaagaaagtgattcaagagtgcataaatcccatcgccgcaggcgatttttaatggatttatgcagttactggtcacggagtgaacagtaacactgtgaagagaagatactaatcgaataacagctgcaaagctagtattcaaagatactgaaccgccaggttacagggcggccgcaggcggatccgcagcaggaagcccggcccctgtgccactttttccttatatccctattttcttatttccgtttctgcagtgcagcacgcagagaggggaacagtaccggcgctgccgccaggaacgccataattatgtaagatgcggtaaggatatacatacactgatcaatcgtatatttctccgccacccttcccagcacattgctccccagggaatcccccaggcttccgcatacggaaagcagcgccagctcaagccccttttgttccttcctgatatatccgattctctccttgggcagtcctacgaaggtacaggaaatagacacgctgcataccaggaataccagcatgaaaataaaaggggaaggtgctttcacaagaaataggccgcccgctgcagttatcagcagaaatatgacattgaacctcaccacgttcactttatccactatccgccctgccagcatataggtaggggcgctgacaagctcgtccatggacatgagaatccccaccttggcaggagaaaagagcagcacattgtagcagtacatcggtatgataaagctccacataggccctgccacaaaggactggatgaataccagaaggcagaaaaccagtatccttttattgattgacttgaatatctgccagacaggcagtcgttctttactgaccgtttcgctgcctttcagccccgcggcggcccagacagaggaggccatcagcaaaaaactgcatatatacagcgcatattccccttcccggaactgatagagcaggccggatatcatgccgcctacgctggcaagcagggaggatacgctctgtacggcgccgtatatcttcccatagccgcctccgtcagccatttccatcacataggagccgcttaccgccaggaaaatcccccggaaaatgcccagagccgccatcaatatggtaaaagccgcaagctcgtccgcccttgccagaagcgcggataccactgcaaggccggcaagtgaggaaagaatgaatttcttcgttcccaggatatcggaaagatggccgatgacaagcttgattaccatcaaacctatggccacggcggacatagcactgcctatcctgccgtagctttgcccatgatccgacattctcagcggaatcaccgtcatcaccacattgtagccgaaagaaatcagccctgaaataagtgtaaacccaataaattccctgtctatcttcctgccggtcttcttctcatgcatcctgccgcctccatcgaacatttgttctattaccataatatagcacatacgttctcattatgcaaggctgaaataaactgtccgtaagcagcatgaattatcgggaatgcatttctgatttaaaaattttcctgcagccggcacgtattttccgttcagcagtaccggccggcctgcgcattccacatttgtgcatacttgccgtttccagccagcagctggctgtgagtgccctgctccacaatccttccgtcctccatcatataaatgcagtcggcatccctggtggtggacagacggtgggaaatgaaaactaccgttttatccgcggcgatttcacgcagcgccttatttaactggtattccgccatagggtccagggcgctggagggttcatccataatgataagatcatttttccggtacaaggccctggcaatcgccaccttctggctctcgccgccggacaggttcacaccgtccttttcaaattccgtagtaagcggcgtctccgtctggtactttaattttctgtcggtgagggtaaaacgtgcgtcatacaacgatttttccacctcataggtttcctttttatccatggcacacaggtccatcaccacattctcccgaagcgatgccgcatagattttataatcctgaaaaactgcgccgatctgtgatcggtaaccggctaaatcaagactgcggatatcctcgttgttgcgagtaatttcgccgctgtccggatcatacagccgcataatcagcttgatcaatgtggattttccggctccgttgtatcccaccagcgcgattttctgtcccctccggatctccatgttaatgtccttaagcacctgccctcctccctgggaataggaaaaatcaacatgggacagccgcaggctctcccaggcatccttcacgggaatactgccgctttttatctgcgggcggtactccaggaacttccttattttttctataaatacactgttcagcctcattttgggatacattcccgccagctggctgcagcagctgctaagacttctgaccgcatagaacagaatgatcatttcactgacggagacacgcttttccacagtcatcttccacagaagccacgcggcatacaccccgtaaaccagaaactctcctgcgataaagtctttaaggaagcccaaaagccagagccgtctgccatatttcatgctggtctgacggatatccctgctgcatccataaaaatccttcaataataaatccttcaccctttcatgcagccgcagttcttttgcgtaatccaggaggtaaaaaactctgtgactgtaggctcttctgcgctccgccggatttatttccaaccgcagcctggcctgcagggcataatacagttttcctgacaacaacgtaattgccagcccggccccggctatcagaagcccttcaccgctgttgccgcagaggaaaaggaagaatatcacagcccccgtcatccgccggaaaaaggtatagacatcctccaggaaccgatctacgcagcggtctgcttccgtggttgataaaataaattcgttatagaaagccgggttatcatagcaggcaagatccatctgcctggccttttcataaatttcttccctgagcttctgatacagcagcggcttcagctttacggaagaccactgattataaaccgcatccgtcagctgatggaaaatgaacagaataaatataagcaacgttgataccgccagctttgaaaagggcatcccttcctccaccgcccgcaggttatagccaatccaccaggtatgctccaggaaaataaaggcttccactttgattgagcccaatacatgtatgaggaaatgtcccggcgatgctttgaagcagaaccggaaaaaataaagctgcctttcaagggcttccttcatggtaatttttttatcttccaccttctgccgcctcctttcctccactgaggtgctctgtaaaaatactccccccgacccaatcctcttcttcccagaccgcctggtaatttctggcctgcatacggtacagggcggcatattccccgtttctgcgcatcagctccagatggcttccctcctccatcagatgcccgccgccaagaagcagtatctgatccgcattctgaacggaggaaagcctgtgggatataaatacgagcagcttatcctgctttgccctgctgatgctttgaaacagctcatattccgcaatcgggtcaagggcgctggagggttcgtcaaacaccataaccggggagtcctgtacgaacgctcttgctgcaatgattttctgggcctgcccgccggacagcacggcgccgtcctctgtaaattcctttgtcagcactgtatccagcccacaggtaagcgcttctattgttttgtcggttccggccagcttaagcgcctgccagatcctttcctccggaattttttcccccatgctgacgttgtctctcacagatcgcgccaggattttcccatcctgaaacgcggtggcaaacaggcggcggtaggaacgcaggttgtattcccggatatcccggccattgaccagtatcctgccctccgtcgggtcatacaggcgtaaaagcagcttgatcagcgtagttttcccggcgccgttatagcctgcaatggcacaggttacccctgcctgaatcgtaaagctcacccgcttgagcaccggtccgccggtacgataggaaaagctcacattctgaaattcaatccgttccaccctttccggcgcgggcacgccgtccgaatcctccggcattcccggctcgtattccatgaaggcgcgcagattggctatgtacatcccctgtttaaagctgtcggtgagggaattggaatagccgatcagaatccagctgaccgccaccataaggctgctcagtacggaatattccgaaagcttcatggttcccgccaccattgtccggtatgcgccgtaaaaaataactccctcaaacatgatggtaaaagtaaaatacagataaccccatccatttaaaatactgcgcagggcatatttatcaataacctttgtcattccttccacagactcccggtgttttttctgcatgacatgaaaaataccggtaaggcggatttccttcgcatagtcggacaggtggactacccggttgacataatctgcaatccttttgaaaatagctgattcctcatacatccggtaggaaatacggttcaacgccgccgcaaacacaaaattcccgataacagggccgagcacgaataaaattgcccatttgtccaaagaaaacagcatcacccaggacaccgcaaccgcagccgtcccaaacacgatctgccagatattgtccaccacctgcagcagccttttatccgtatcctccatagccagaagataacggttgtaaaattcactgtcttcaaaacaggccagctccatattgcagaccttttcatacagcctccggtacagcccctgatagacatccacgtcagccagcggcttcagacgttcctcataccagttttcaaacaggctcaggaaaaagaacaggcctatcgtccctgccaggaatcctaaaatctccgggtagcttctgttttcctccagcatggaaacaagctttttcaaaaaaaagccgctgaaaaacagccaggaaaaatagcctgaaagacagaccagcccggaacacagaacccggccgggacacagctccatggcaagcttgagcatataaaaattgttttttaccgctgtttttatgttgtattttttatttgggattttcaacggtacatcctccttcgccgttttgttatatggtaaggctattatatctgattctttcctgctgcggatgcagtctccccgaacaggggcactttgtccttaaactgtccttgccggaagctgcgcagatgacctataataaacacatgaaatcagaaaggagccattttcatgcttcaggtaggactttgcgacgatgaaccggtactgctggatacgctggaggaaaaggtgcgcaggtgtttttcggaaaacttaatttttgctgaaatacaggcatttaccggcggccaaaaccttctgtatgaagcggaggacgggaaaaggttcgatctcctccttctggatattgaaatgcccggcatggacggccttgagctggcctcccgcctcaggctgctgcttccggacgccctcctgatcttcattacctcccatgtggaatttgcgctggacgcctatgagctgtccaccttccgctatatacctaaaaataatatggatggccgcctggagcacgcgcttctggacgcggccgccgccatacagcttcagcagtcccagtcctatattatcagcaatcagaacaggctggaacgcatcccgctgaaaaatcttctctatatccagcatgtggaaaagaattccctgcttgtcacggatctgccagccccggaaaataccgggaaaagcggcggcgcggagcacacggaattcaaggtaaggaaaaccctccaggaaatctacgaggaattaaatcctgatgatttcctgtttatcgacagaggcttcatcgtcaatctctcccatgtcatgagcgtaaaggccggctgctgcatcctcagggacggcaccaggcttccggtcagccaggcgaggatgcccgtgctgaaagagcatctgctcagcttctggaaacagcacatttaacgcacgaatccacagacacagcataaggacggcggaaaagaatgaaaatgagaaaaacggaactgctgaaggaagcggaggaaaagaaccagcttctgcaccggcaatatgaaatacttcagaaaaattatgcggcgaacgcacagctttttcacgacatgaaccatcatctgcaggttatctaccacctggcggaaaaaggggaaagcgaaaaaatccgggcttatatcgcccatgcggcgcgcccggtacaggagctgtccggctgcgtctggaccggcgtggatattgtggacgctattattaaccagaaaaaacagctggccgaggaaaaaggatatacaatggatatcaacgcccagcttccttataatacaggaatcgcttccgacgatttctgcaccatcctctccaatctgctggacaactgtctggaagccatggaccggaaacccagacagcgcggggaacagcctccggagggcgcaattcagctcaccctgaggcggattaatcattttatcctgattcaggccagcaatccctgtcccgatatccggataaaaagaaagggcttttttcctacttccaagaaaaataagcttttacacggctgggggctgaaaagtgtggaggccgctgtccgaaaatacgaagggacttttcattgcgaggtatcggaaggaaggtttacggcatcagccatgctgttttttccggaaacgaatggaaaagctgagagccttatgaaaaaataaggtaactgttcagctggccaggttttccctgcaagccgggaaaggcagggctgctgttgttttatagttgcatttgcggaggtgtcattatggtaaaccccaaatttttaatagaaacaaaacgtcttatcatcagagaaatgcagcaatccgattatgatgcattgtgcaggatattatgtgatgaagaggtgatgagtgctgcttatgaaagtgcattcagcccggaggaagcacaaaattggttgaacagacatttaaaaagatatgaagattatggttttgggctttgggctgttgtattaaaaggaacaaatgcgatgattgggcagtgcggcctgacactacagccctggaaaggcaaagaacttctggaaattgggtatttgtttcagaaggcgtactggcataaaggttatgcaacggaagcggcaatcgcgtacagggaatatgcgttcacagtccttaatgcggacagcgtctgctctatgattcgggacacacatatagcttctcaaaatgtcgctgtccggaatgggatgaaaattattgataaaactactaagaatttcaggaatacagaaatggaatttttcctgtattctgtagatcgggcaaaatgactttaatattttgaatgttcccaatgattcggcaatcaatggaaattataaagaaatatgctaagacggtacagaattaaaggaggtatttccatgaagcttttatccatgctgtccgaggttattttccaggtcattattttttctctccttcccttcctctggtggtttttcacggcccgcagaaaggagagcttcttttcatggattgggttaaaggcagtcaaaggaagctggccgaaggttatcggcggcatcctcttctttttccttctctgcctggtttcacagctttggtggatccctcacctgctgcctgccggggcaacagtacaaagctcctacgccggaatggggtggagcgcatttccctccgcttttcttttcggaatcatccagaccgggctctccgaggaaattctcttccgcggcttcctcgccaaaaggcttatcagccgcttcggctttgccacgggcaatctgccgcagggactggtattcggcctcctgcacggagctatgttttttctggtgaccacactactgaaagcgctcataattacgctgattactggcttctcggatggatggcagaaaaagcagcaggcggctctatccttcccggatggatggttcacggagtcgggaatctgctgctctctatggcagcggcattcggattgctgtgacagacagggcggcaaagtgatatatacatatttcccatgcatcaccttgccgccctgtaccgcctgtttatatgttatctgccctgtcccgtttccaggcggccgaagtttttcagcagcacaagcttgtccactgcggcggccgccttccaccagttttcactgatggcaaattccttcgcatatttttcattgttatcaaaccaggtccatgtaattccccagacaccgttctccggcagggtctgctccaggtagtccagctccttttcaacaatttctttgttatcctcatagcaggcgctctgcggcccgatgatgtagttggaggggcggacaccgtagtaagcccatttggagacatctgtttctatggaatttttcaccaggatttttattttttcccaaagggcatcgtaatcatagtctccatacttaagctccttcagtgtttcaaccatccccataaatccggcgatgcccatatccccgaaatcctcacagtcctgaaagccggtaagcagctgatttgttattttttccgtcttcctgtacagttcggatccgggatccatatatttcaggataaacgtcgcaatgtcgcaggtgggaccgatgctttccacaagattcctctcttcatcatactgccaccagggcgcatggggaaaattatcatttgtgggaatgcagaagcgccagccgtaatccatcagatccttttcgctgtacagatacctgaaaatcccctggcagacggggtgttccatatccgtaaaacctatattcctcaatatacgtatcgccatggaggtctgataagggttggaatcagggttccagttatcggcatccagggcatatccaaagccgccgtcctcattctggtaccaggaaagggcgtccgccacgtcccggtggctcccgttttcaaaaaaataattccagagactcagctccacctccctggcgtttctgtgcatccagtacttaatttccgtcagtttattcaatgctatcaaaggggtatcctcctgcttttttcggctattataccatggacatcgtggcaggtattgtaaatttacgacatgtcagccggtattgtaaacttgcggcatggcggcaccctcatttttccccggcggactgactgcgcgcataccgcctggcctcctccggccgcatggtgtgatattttttaaattcatgaagaaggtgggactgatcggaaaagccgtaacgccggacagcctccatcacatcaaaggccggagcggtcaacagttcattccacaggttctggtagcgcaccagcgaggcaaactgtttgggagagatccccatatattcccggaacacccgttccagctgccgattgctgataaatactagatccgcaagcccggcagttttcagatttcctttctgcttcagggtatggtaaaccgccgtctccagataggtattttgccgcttttcattcagctgcttaagaaggattttttccgccgccctggaacgcccctccagggtttggatatcgtacagaagcggttcaacggccttttggatcccggcataatgccggcggacgtcaaacacgttattcttcacctccgccatggagtccccggaaaaaaggaccgcgctccaggcgaaaaaacggatgccgaaggtggagcggatttccggtctaccgctctccttcggcagtcctgcagaataaaaagcttcattattaatgccaacgaatttgccggatatattattgttggtgtggcttacctgaaaaataatatccatgcaggtgtcgggaacaatcagcccttcctgtattatcccagtgtctgccaggggactgtctgttccccagaagcattttacgtagggttgcagcccgccgcagggcggaatttccctgtagcctccgccgcttctgtacggcgccgctgtatggggctgatacatttgataaaaccggttcatacagactccttccgtaaaagcctttccgcagcgggttattcagaagctgtgattccttttctcatacctgcgccgcatccatcgttgggaagtcttgtaaatcccagtttttcataaaaaggttctttgcccttgcgggctgtcaggccaatggaagcccagggagcggtcaggctgccctgcgcatggctgatgagcctttccacaatggcgctgccaatgccttttctctggtattcgggaagcacggccacatcctggatataccaatacatgctgccgtctcctacgagacgccccatgcctatcagcttttcctcatgataggctgatactgtaaaaagtccgttttccagggctttttccgcctgcgcatatgggacctccatggcgcccgcgtcaacgcggagacggatgaattcttccggagtcagggtgttttctttgagttcgatattcattttatggtatacctccttaagacctatgtaatgatttttgttatagcgtaatcataccctatttatcggactttcgcaaacccgaataacaagcaatggatattcagtatcaataatgcagaatatcaagttttattcgtcatttagtttaagaaaaaccatgtttagtccgataatgttaatagtatagcaattcgaaaccactactctatcaatgggagaataaacatggtaaaaaacatcaaaatcaagcattttctaatcctgtcatttgcactgatcctgttatttatgaatatcctgggcggaatgtccattttctacatgcaaagactggccggccagaatattgaattttacgaaaacacgcataccgtccagatccagatagaaagcatcgaactgattatgtcggaaatatcgaataaaatcagagacgccgttatttacaaaacagatgaccataccagggaatccaccgcgtacatagagtcctctttaaaggatatggaaagccggataaccactgtaaaggaacttttcaagggcaaccgttccctgttggacagtgcggacagcgcggtagccacctggttcagcgaaacagacaaactgaaggaactcctggagaacgaccgatttgaagccgcgcttaacgtatttgaaacagactacctttccgcagaaacaaccatcaccgttgccgtagagcagatcaaagaagagacgcagagcacagccctgggatattatgaaagcgccagacgcagtaaggttatttctctttatgtaattctctccatgcttgccgttaccattggcttaacctatttactgtgccggatccttcttaaaagcattgcctatcctctggccctgattaaagacgctgcttttgccatgtccgaaggaaacctgcatcaggaaatcgattttgaaggaaaaaatgaattcggccagcttgcctctgtgctcaggaaaacgtcctccacactgtctgcttacgtgaaagacattgaccgtattcttgcgtccctgtccgaccaggatctgactgtggagctccgtctggaatatgtgggtgatttccaagaaatcatggaatccctgaaaatgatcattcactcctaccgggaaatggtcgggcagattgaagcttctgccgatcaggtggaagccggttcccaggagctttccgcctcttcccaggttctgtctcagggcgcgtcggagcaggccgcatccgtccaggagcttaccgccagcctgaatgaaatctcggcaaaattaaaggaaaactctgaaaataccgatgctgcgaatgaacttacggcctccgtgggaaaacagcttgagacaggaaacggacagatgcaggaaatgctggacgccatgtcagcaatcaatgcttcctccaatcagatagcgaagattattaaaacaattgaggatattgctttccagacaaacattctagctctcaatgccgctgtggaagcggcccgagccgggagcgccggaaagggctttgccgtagttgccgatgaagtccgcaatctggccggaaaaagcgccgaggctgcaaaaagtacggccgagctcatacagaattctattactgccgtaggcaacggtgcctctattgccgacagcacggcgcgcacgctccaggagattgtatccggcgccggcgatatcacccggatggtttccaaaatagccataaacctgcaaaggcagtcggacgcagtcagccagatcactgtcggcataaatcagctcaacgacgtcatccaaaccaactctgccacctctgaggaaagtgctagcgccagcgaagagctgaacagccaggcaatgtccctgaaagcgcttattgacaggttccggctataggattggacggatcgatatagatggcagcacataggcttccccggggaacggcattgaggtaattttacctgattacacaggaaaaggcacaggaagagcgttgggagcataccacgttcttcctgtgtctttttatcgtttgcccggatttgtttttctcccgggtgtttataggactgagtatagggggtgccccgggggcagagtcaatattaattggtgtggatatggaaaagggctccaacattttcttaacgcagtcagtatccacattctttcgccgctttgcccgcggtattaatttggcggcctctgtagtgtcacgattctcatatgcatcctttttcaggcagatgaaaatatctgtcttctgagtttccattcctccggattttctgttaattctttaatcaggcgcttgcaagtcttccatatttcgtcaatttaaagctgaacaactatataaggttctctgccgggccgttccagttatttcaaaattcatatcatctgacaacattatttctgccaacttaagcgtcattatggcggctaaactcaaaaaagcctgacattttacctatccaggcagactatcctccaaacacaacgccccatatccagtcctttcattcggatatctcgtctccccccgcacgctcctggctcctctgcgcagatgcgctttcagcttctctccatacatatacggatcattccctctcacaatcccccactccatcatcagcgccgccgccccggtgacaagcggtgcggaaaaagacgtacctgtatacgcctcataaccgccgccggcccgggcggctacaatattcacgccgggtgcggcaagatccggcttggtattgggaaaacccggcagttcttcttctccccgaacccctctgcctgaaaaatccgcataagcatcgtaggctccataaatagcgcccaccgtaatcagcttcccggccgtggacgggaccgtaagcgtcagctccggcgtcggggcaaaaaaacgggtatccgccgaacgtaccgcctgcccgggcagatacagctggtattcccctgttatcagaaggaccggctccagctgaaatacccagataccagcgttaatgtaagtttccacaggaataaaatcaaaatatatctcctgatttactgaataaggcgacggctcccccacataaatgagtatccgcgtctgatcgataacaagctccgtccgccccggcctggtcatcgggacctcctccctctgcccggaaggggcctgcagaatcacccggaagctgtccgcgaagtttttccaaagctggacattggtcgtgctctcataatttcccacagccagctccacgctctgcctgccggcaggctgccctggcccgccttcagaaagtctcccggaaacatggccggcagaagcaccctcattgccgctccccgcacaaatcacatttttccaaatctcagaagcattatccataaaacgctccagaagggaactgccgtcatgcgcgccgtagctgttcccgaagcttaaatttacggccataggcatacccaaagcctgcgccttgcccagtgcataggtcattgcccgcatcaactgggtcgtgcgcggataagcaccgctgccagcctgccccagctttacaataagcagggccgcaccgggcgccgcacccgtataccgggcattgggattactgcccgcagcaatggcggccaccgcagtcccatgcccggaaatatccatactcggcactctgcggaaggtttcctccccgccagcctccagcgcttccgtaatctgcgcctgcgtaaactccaccccgacggaaaacccttccggcgggaaaaatcccctttccggatccggcgccagtgtctgatcccacagataaagaatccggctgcctgcactgtccctgaaatccggcagcgaataatcaattcccgtgtcaaacacagccacaatgcagccgcttcccgtcagcccccctctgtccgtctgtccgcccgtaaaactcccgccgcccgtaggaaaacaggattgctgtttagcatcataaacgctgtataaaagctccttcggtttttccacatattcgatcccttccgctgccacaagcaccggaatcaggctttcaggtatggtgactatggcataaccggccagcagaatttccaccttgatatattcattttccagcctgccgatatcaccatggaatttaacgatcagctcccaggtcctgtctgaaacatcaaagcccacgttaagggtcctggagagttcccgctcctcctgcgtggaatccaggctcagattcagaatattttccagcttctgtgaattcatcccatttcccccttccggcaaaaagcaaaatgcattacaggattaaaagagccggcggaagcaacgttccgccggcacaactcttactcttaatctatgaactttcggaaaaaatgtgtaaccgcccagccaacttctacagcttggaatagccatacccattcaccatggcgtcaagcttctgttttgccttgcaatacggacaattatgtacctcatatgcctgatacccgggaatgtcgctggtatcaaacatggactccaccctcatgccattaatagacttaatagcgctgaataccgcacagatcccctgtacctgtccgccatagtactcaatacactcaaggctcctgcgcatcgtcatgccggtggttgcagtagccagcagcagcagaacgtttttcccctggatctccccaaccaggttatcccggaaaatcatctggttattcacattaaactccggcgttaccacataaaccgtgttgtgcatattcatggaaggaaaactccctttttccagctcctccgccatatatgccccgattacttcacagccgtccaggcagactatggtatccaccaccgtctctatgggcagtctctgcacaaaggccttacctactgccgcagcctcactgcgccttgttttcagccccgtcatatccacatagtaattgatatgggagtgactcgttgcaaaatggcccggtattgccctgagaataatattgcttccggcctttgaatagaacttcatcaccttattttccataccttctccttccctgcgccgtacgcacctctaccagatttacaatttgaagtataaccccccccctgctgccgcggcaatccactcttcctgcataaccggttctcctgcccatccgcattcctgcataaccggttctcctacattcccgcttctcctgcatccctgtttctccatcataccggaaaaatgcacctgtcagggaatcacttttacttcgaatcatatttttattataagtgttttggaatatttttacaagtttttatagcgtcagcgcacttttataggcatttcaaacaattttctctccgacaattcagcacttttttcacagttatccatacctgcggccatcctcacaaatttccccaaccatcattccttcattctcaccggatctccttctgcaaaatccctgtccgccgcattgataaccttagtgttaccatccagtgcccctgactgcagcgcagcatacctgttattcttatccagaacctctaccataagcttctccgccgtcagctcttttccaagaatcccgctccgttcccccagcacatacacaaaattacgctggttttcatccgtatgaagcgcatcgatggaaatacagcagttatacagctcagactgtacggacaaccggaaactgccgctctgccctatcgtacccacgccctccggcaggttcatcaacacccggaagctgccgggactggactcctcctccgtcagataatccactgttacctccgtttccacgctgcccaggctgacacttgcactacttccctgattcacatatttcttatcctctttatccaaaatcacctcaaactgcaacggttttccagtatcagcaaacactaccgccgcacctgccggagtattctctcctgccgccactcccacacgcgtcacaatcccggcctgttcagcactgatcagcccctctgccttcaccagctcctgaagctttgccaattcttctctcgcagcctccaaatccagccggtaaatccctaacgaactgtccgaaagctccggacgcatactgtcctccagcccccgatccgcttccagcttcgccttttccaaagcatcctccgcatcctccacagcccgttgggccgccatgattttatcctccagactcttcctggtacttctccagctctcccacttcgcatcctcagacgtaaagtcaggctgcccgggcgcattcccctgaagcgcccccacctcttcagaaatatcctcctgcgcataccccgcctgcgccaattccttttttacctgtgaaagctccgcctccttctccgccagctccgccttccaggcctccacctcatccttatccactccgcccgagccttcgctgctgcttcctccatcacccgagcccccatcctgacccgactcaccttcctgtgtccccccagtcatgccattcccgctgaccgaaccggaaccgccatcctgcgccccctctataaccataccttccgccattcccccctccgatatgttcccctcactcctatctcctccactctttgcgccatccgggcccgaaccgctcccctgcgcatccgcaatctttttcttcagctcatccacctcagcctgcagactctccgcccgcctctgcagctcccgcaccctgccggaagccgattgcacctcctgcgttccctgaaaaagccttgccttccactcctgataagcctcctcctgccgcttacgctcctcctccgaagtcagcttcaaattcttatccagatgctcctgcagctgcgcccgcgcagccgcctcatcctccaaagccctgtcaagcgccttctgcgcctgctccacaacccggaccgcatcctccccggccctgctcatctccacattcttttctgcccctgccagctccagatttccctcaagcgttgccacctgaagctccagcttcgcaatactccgctcctgagcccgcaccctccccatcagatactccccatccaacgaaaaaagcgccgttccctcctctatccgctcccccggaaccacaaacacctcactcacccgaagcccctccgccacattcacagccagctccccgctccccttcacattccccgccttctccaccacatgctcaaccgccatccgccccggattctccacagaaacccgcggcagcccattcgcataaatccccctcgaaaccaacgtcaaaaccaacatccccaccaaaaaccccgcaaaccacttcaaaatcctcttcctgctctcaatcaatccacccatcccacatctctcctatcaatattccgtaactactccacccaaactcccaaccccaccactccaaaaatccacctatcccccaatcctttcctaccctcactttatccatatccaactctaatccttgtctttgcccttgtccttgtccttgcccttgtccttgcccttgtccttgcccttgcccttgtccttgcccttgtccttgcccttgtccttgcccttgcccttgtccttgcccttgtccttgcccttgtccttgcccttgtccttgcccttgcccttgtccttgcccttccctacgccccacactcccccaggctctgcggctttccgcagtctttcccggattgcccctcgtcccgtcctcctgtccggaggggattgcgggggattttgactggaagttatgaaaaaatggagacatttcttacttcccggattttcatgccgcggtctgcccaaatggtgctgtccgacgacggaaacggccaagtcgccggcgacgcaggccgcttccggaggagttccaccatttagaccgcgacatgaaaacccgggaagttagaaatgccccatttttgaatacgcacagacaaaacccccgcaacccctccggacaggaggacgggacgagggacaatcccaggaaagactgcggaaagccgcagagccgcccctactccttcaaagcggaggctacgatgccctgctcgagataatcctgccccagcaaaaagacaaacaccgaaggcaccagcgtcaccaccgaggccgcgaatgcgaacccggccctgttctggctgatttccggcagatacagggacagcggccaaagcgacttatccttaagaaaagccagcggctgttcaatcatgttccagtactccagaaatcccagcaccatggcggacaaaatcccgcccgatgccagcgggagcccgatctgccagaacagccgccactcccccgccccgtcaattcttcccgcctccagcagccctgacggaattgtgcagaaccccctgtaaatcaaaaacaccggaaacgtggaaaacaccgccggtaaaataaccgcccaatgcgtattcatcactcccaccctgtccagcaccagatactgggaaagcatggtcacctggaaaggcagcagcataagcacaatatatatggtaaaaaaaagctttttcccccggaacctgtatacggcaaagccccaggccgcaggcacacctaccagaagctgacccgccaggataatcgtcaccagcctgcccgaattccagaacaccgtaaaaaactgcggcgtatacaaaagaaggctgcggtaatgctccagcgttggataaaatggcagcgccctccagctgatgtaaccctctccgccctgaaacagcggctgcagataaacggacagctcctggctgctcattatggaaccggacagcaacagaaacaccggcgcgcacatcagcagtaccggtcctgtcaggagcaggcagaaaaatccccgccgcgccatgcctgtcagcttcctcagccttccacgcagccgcccttcccgccgttttctccgttccttcactgctcatcacccccgtcccaaagcctctgcagcagcagaatgacgattaacaaaacgcctcccacacataccgcggcggcagccatcttatcaagatccaggtaggtaaaccagttgttgaacaaatgctgcagcatgtacatactctcatgaggataggcccccgccaccagatagctttccctgaaaaccttgaaggaatttaaaaaggaaagcaccgttatggtatacatgctccctttcagctgcggcagcatgactgaccaaaatacccggaagcttcccgcgccgtccaccctggctgcctcaatgaaatcccccggaattgccaggatcccggccagccacaatatcaccgtataacccaggtttttccacacataactgaaaaccagaacccagaaagcatcctccgtccacataaaatccacatgtgtttccagcagccggttcagaaagccgtcaacggaaaaggtcattttccagacaagcacgatggtagccgacggcattgccatgggaagcaggaaaaaagatttgaacagctgcacctgttttaactgcgaaagcataagcgccgccgccaatcccagaataagcagaagaggcagacaaatacatgtaaaccgcagagtattatataccgccagccggaaaggtccatttccaaatacggtccggtagttctccagtcccgtaaattctcctgtaaccgccgttgtaaaggaacgccggaacacatcgataaacggaaccagcacaaataccgccacccccagaaagctgggaagcagaaaggccaggaaggcccttctgcttctgtgctgcttttgttgtgtacgaggttttcctttcacactgcacactccttattctgccagataaatggccgatttctgctgtatctccctcacggccgcttccacagtcatggagccgttcaaagcagaaacaccatactgcaccacaatgtcctcaagaaatgtgtttccctccagggaatgatccgcctgccctacaagctccttcagcctctccaccgaagccctggacggacctccgtaggagaaatggatttccctgcctccgaccttccagctgcttcccatggaaatctgatcgtccataccactcaacatatcaaaggcttctgtgtttaccggtaacccgactcctgaattcgttttctggatttccgtactgagcatcatttttacaaagctctttgcaagctccgtctggctgcttcctgcggctatggccagcttgtttgccgggataaaaccggttccatccatgcccggccataaatcaaatacatagccattatcttccgaaaccttgctgacggcgcccatatcagacagcatcccttctgcatttccggccataatcccaaccatatcccccgcagtcagggtggctatcgaaccaatcgtccaggcgttcttattatcgccccagacctccagctcctccttgccgattccttccatgtccgcctggtatatccgggccgcctgggtcagaagctctgtcagtgcctgcgtattcagtttcctgtcctccagcagactgctgctgttcacgagcagcaactgcttcagctcctgtgttgcattaaaagctcccgtaatactgctttcaggcctttctgtacgcagcttttccaccagctgcgcataagtggacaaatccttcaccgactccacatcctcctttttaccgcatatcataggaagcttaaacgcagcgggaatgatgaaggttccgttttcctctttataagcggatgcgatattttcaaatacctttttttctccggtcagttcgtccaggatatctgacaaatccgccaacattcccttccgcacataaatatccgcatccatatcatccagcagaagcacatccggcccgttcccgctcatcagttccacattgaggttcttcaacgcatcctgaggcgttatggcgctgccgctgtcatctccatacagataggcataatcataaatatattcgtaattgatatatacatccgggttttccttctggaatatggatatcgcctgcctgattgtataattttccaccaggctgtataccttcagctgcttttcaggaaccgtgggttcattcgggtcataggtaaaacgtaccatctcatccccggtagtcaaaagaaggaactccccgctttccagccggagcatgccgcacagtccaagcgcgggatctccaaggctgctgaagcttccgtcaatgagctgctccatggcattgccgttttccacatgacggtacagccctccgctgtatgccacatagatggccccgtcttctccgggaaaaaggatgccgccgtagctgtcggagctgttattaagctttgctcccattttttctctgcaaaactcatccagcaccgcatccttttccagggtgattccctgtaccatatcataggacgtaacaccgctgttgcccaggcacagcatcctgtcgtccacaaaaattaccatttccggctgttccggcagcgtaaaaagctgctccagttctcctttttcccagtctgccataaaaacccggccccttatactgagcgcgatgctttccgattccgatttggcgaacaccttgcccacataatcgccgtcctccatgtttgccgggacttcagacatattcccatccacgccgattcggataactgatgaatctgccttcaacgaagccccttcgccttcaaacatcagatagctcagcaatatactcccgtcaggcgcaatggaagcgccggacacataaccatcctcggaaatattttttttaagctcctcattatgttccgccggtatccagctttttccctcttccgatgacagatgaagtcctgactttgcgtcaaagtacgccagccttccgtcagtcagcatagtcatggtacgtccttctaccgatgccccttccggcagcggcgccgtactttccatatatcggcccatggccgccacactgccgctctccgcctgcgtatccctgccgttttccttcgatgccgcctcggactcctccgaagccgttccccctgagcccgttttctttgtcccgcatccggtcatactcagcagcacagtcatagtgtacagaatacaaatcaacagtgccggaattctttttcttatttttttatgtttcagcatataaacctctttctgccgtcctccggaatcaacccatgcttatcctgtcttttattatcgctgcgcgttgggccggatgcccgcccgtgctgcatcttcgttcatttccccgtaaatgcgcaggtcaatcagatcctttttcacagcttccttcccagatcggcaaatcttttttatttccgcgggcaacgagccaggcatccatgctttcatagatatttggcgactgccgcgaaagtcaaatgccccgctgcccggcagcgctgcaaaccagatgcttcgttgctgcagcggggtgtctgacaattgtcagttcaacactgcatatctcctgcagtctggtttcatcataccagaaattcctctaagctttctctaaaaccacagctgttctgacaacataactgctaattacaattcactccgcggaacaataacagacttcgcaatgcacacaaaaaagcagcttctgcttattttggcgctgcgttttttcttccaatgctgcgccccttcttccaatattcgttagagattgtttagatacttttatgatatactacttataaataccagtgcttttactgcgcatgcccatacggatacgcggcggcagccgggccattgcgcgataattccaaataaccggatacctgtaactgttccgttatccgaacggctgccatgaatattctctgagggagaggctatgaaaattttacttgtggaagacgacagagaacttaacaggacgcttcttttccagctggaaaaggagggttttttagtggattcctgctttgacggggaagaagcctgttactatatgcaggaaggtctctatgacctgattctgctggatcgcatgctgccgaaaatggacggtatcgctgtcctggaaaaaatacggcgggaaggaaataccgttcccgccatcctgctgactgcgctggggacgctgacggataaaataaccggcttagactgcggcgccgatgactatctggtaaagccttttgcctttgaagagctggcggcacgaatccgcagcatcggcagacggcccaggcggatggaggaggggcggaagctttcttttgatgacatcagctattctccggaggaattaaggctggacggccccgacggatcctgctccctctcccggagggaagccgcgctcctggaggcttttctgagaaacagcggccagtcgctttcccgtcagcttcttctctgccgggtctgggggcctgatacggatgtggaagagggaaatcttgacaattatatttattttctccgcagacgcctgaaaagcgtgggcagccgcatacagctgaaaaccgtgcgtgggataggctaccgcatggaggattaagatacataatatgctttgcggcagccgccgcagaaacagaggttaatatgttacgacaagtacaccggcgccttacgctgctttgcgcaggaatcaccatcctggtccttatttttatggcctgcagctatctgtatatctccgaaaaaaacctgaaggaaaacagctttgcttctttccgcaacgatatgaacactctgctctccaatctggaaaatcagacggtcatcacacatgaatggctttccaagttagagggcgggggaaaatacataatcagcatccatgataacgacaaggattttctctggggacagcaggatggcggcggcagcagaaaggcggccctggaggccggctgggcctattaccaggaaaatgccgaaacgtttcccacgccccttgcctttaccatcacccatcaggagttccgcttttcctcagccgggcagggacaggatgattatttcggctgtatcgccttatcctccagaaatacggggaagctgacgatactgattctggaatccctggccccactacaggaacaaataaaggcgcagcggcatactttttttatgctggtggctttttcctccctggtcctgattctttttgcctacttttttacaggcagacttctggttccgctgcaaaaaagcagagacagccagatccagtttgtggcggcagcttcccatgagctgcgcacgcccctttccgtgatcctttccgccgcctctgcctgccagaaagcttcgcctgccgaacaggaatcctttttccataccatagaaaacgagggcgcggccatgtcacgcctcatttccgatctgctcatgctggccggcgccgacagccattccttccccctgcgccctgaggaatgcgagcctgacacactgctcctgaatacctttgaagcctttgagccactggcccatgaaaaaggcttccgcctgtccgtccggcttccggaggaaaaaacagcacccatccagtgcgattcggaacgcatccggcaggtgctctctatttttcttcataatgctttcagcttctgtcccaaagggagcgatattacgctttccatgaagcagcaggaaaagcttacctccttttgtgtcatggataacggtcccggaatcccagacgaagaaaaacctcatctgttcgaccgtttttaccgttccgacacctcccgccaaagcgcggggcatttcggactggggctttccatcgccaaagaaatcatggatgcccaccacggcggcattttcgtttctgacacgccgggcggcggcaccacctttacaattacagtcaaatcccccgccgcaggtaacggggcctcaaacctgaaacgccatggacggcggaggatctgactcccggggcaatcgccaggtaatcgcacaggcgcgttggtctggctcatcgcccgcgaaaataaatttttacaggaaaagaccctggcacagccttaccagatattccgtatccttcacgcccgctgtttccagcgcggaatgcatggcgagctgggcaagtccgatatccgccgccggaattgatacgtgcgcggaggagatgttgcccagcgtcgagcctcccgccacatcggccctgtttgcaaaattctggcagggcacgccctgttccttacagatatttctcaccaccgccgcagaataggcatctgtggtatatttctggctgccctggaacttcaggacaataccgccgtttaagtaggggcggttggtgggatccgatttttccggatggttgggatgtacgccgtgggcattgtccgcggaaagcaggaagctgccggcaagaagatcccttctggcggaaccgctcagttccagtgcgtcacagatacactggataacatctgaaaggaaggtggaatccgccccctgcttggttccgctcccgatttcttcattgtcaaaaagggcatagacagctccgtattccccctgcgcctctttttttgctcccttttccgacttttttccgtcatctgctgcaagaaatcccgcgagcgttccataagcacactgcagatcatccagtctgggagacacaataaattcaccgtccactcccattcttcttcctttttcccttgtatacagatacagatcagatgccaggatgtcttcctctgaaacgcccagcgattctgcgcaaagcgccttaaggctcttctttttcagctttcccttattctcttcttcgttttcagaagacgcctccggatttacgccgccgtacaggggaagcagatccacctggggattataggcaaagcccttgttgatttcccggttgaaatggattgccacattgggaatgatgcagagatctctgtcaatattcacaagcttcgtaaccggcctgccgttttccataagaatcgccctgcctgccacagatagaggacggtccagccaggtggacatgatcatgccgccgtagccttccgtattcagctttacataatggccttccacatccatttccggcgtttccttcaccttaaagcagggcgaatcgctgtgggacgctgcgattcgcaggcctttcattttacctgcgggaatgcggaaggcgatcagcgcggaatcattccgcgtggcataatatcttcctcccgccctgataccggccgccgtttcacagacaattttcttataaccggcttcctccagcatcctggccgcattttgtaccgcatggaaggcggtggggctgttgtcgataaaacggaacaggccttccgtaatttcttctgtagtgaagcttgagttttccattttttaatcctcgctttcttacatttaaagcatacaaatattcttcgtatctgtccggccgggcagcgcatttactattttccgtaataatccagactttaccgaacggttacattttaccaaatctatggctcaatggccagagccaaatcctcctgaaccctcactccctgtatttttccgcctgcagccggaacatatatgcatatctgccgcccgcagcagtcagttcctcgtgtgttccgcattcaaccaactttccgctgtcaaacatataaatacgatctgcatgtctcgttgttgaaaggcgatgggaaataaagattaccgtcctgttgccggcatattcgtaaacagcctgatttaattcatattccgcatccggatccagcgcgctggagggttcatccagtataatgagatccgcattcttatagaatgcacgggcaatggcaagcttttgctgctctcctccggaaagctgggttcctgaattttcaaattctctcgtcagctgtgtttcaatgcccagaggcagcgaacgcagctttccggtaaagctgctgttttccagtgcttccagcactttaccggcattctgtgcatcataccggccgcccgctacattttccccgacagaacaggcgaatatacggtaatcctgaaaaacagccgccatccgctgccttatgctttccagagtatactccttcacatttctgccgttgtaaaatatttctccctcatccggatcgtataaccgcattaccagctttgtcagcgttgtcttacctgctccgttatagcctacaattgcgattttttctccccggcttatttttaggttcacctgcgaaaccgccgctttttgcctttctcccgtaccataactgaagcttacattcctgaattccaatgattcaaacgccggtgcggccagtgctcctccaataattgtgggtctggaattcataaagcaacgcattttctcgataaacatgccatgttcatggtattttaacagccgctctaccatatcccgcaaaaaccataccattttccacgaagcattaaccgcaaccgcaaagcctcccagccccacctcaccggtaaccatcaccttatagagcatcagaatgataaggccgctctcccctgctatttccgaagcgctgcgaatatagtccaaaatggcaaaccttttaccatagctgtccgttattcttcttttctgcgcaaccgtatccctgtattcatcaaaaagattttccgttacgtgcgtcactctcagatcctttgcataatcaggaagcctgaaaacacgctctatataactctcctttcgttccagcggattcaaaagagtccgataactgaggctgattttattttgaatcagagtaaggcctattcggacggcggcaagcaggaagataattaccgccatagtgctgtccacaccaaacataacgccggtcagcgtaacggatgccataatcctgttgatcagcttccccgtatcctccatcagtcccactgcatgctcaaaagactgatccatcgcccatacaaaatcattatagaattccggatcatcatatttggcaaggtcaattacaaccgcctgcctgaacatgtccgtgtgcatggcaatatgtaatttctcacggattttcggattataaatctgccaataccaatgatgaaacagataaaaaaatatgagatataccgcataacccgcaataacccgtgccgccgaataaaaagggacatgttctcccagcgcatcaaataattgctgcatatagatgatgcctacggaatgattcatcccccacacaacgccttctacgaccatccataccacgtagcccggcgtacatttccagacttgcttcaacatccagaaattatttttcatgacattgcggcggccctctttacgaatatactccttcattcagccacctccgcataattctgcgcctgtttcctgaacatttccgcatatttcccgttttggtccatgagcccggcatgtgtcccttcctcaattaccataccgccgtccatcatgtaaatccgatccgccataacagcggaagacagacgatgggagataaaaatcattccgcagttttcacacgctttcatcatactctcatacatctcatattcagcaatcggatccagcgcgctggagggttcatccagaataacaaaccggttttgtccggaatacacgtgggatatggcaagcttctgctgttcaccgccggatagctgcatgcctttttcatcaaattccctggtcagaaacgtatggatttcctccgggaacgtccttactttttccaggaggccgctttgcttcagcgcttcccttactctctcttcttcaccgggacggcatcttcggagcattacattatccgccacggaaagtgcaaaaatatgaaaatcctgcataaccaccgaaaaaatatcccggtacttccctaatgggaatttcctgatatccgtgtttccataggtaattgttccctgtgcgtcatataggcgcagcaaaagcttcaccagcgtcgtctttcctgcgccgttatggcccaccaccgccactttttctttttccccaaaccgcatattcagctgcttaagagaatcctctgcagcgccgtcataccggaaggatacattttcaagtacgatatcccctccggagggcagttcacttacacctccctttactgtcggctcataatccagaaaggtacgtaaattttctatgtaaaaagcattttcctgaaactttaacagcatgccggcggaatcggtaaaggtatgggcaatgacatcaatggaattgaccactacaatacagtcaccgtaacccatggttccggcccccagagtccgccagaccgcatatatggttacgctgagcgccgccagcatttccgtacattccatggtcagataatttaaagcagccagggataaaccatatttttttatgatgtcaattatcctgccgcctgactcctgaaatcttttcaacataagctccggcatgttgaaaagccgcatctccttggcgtactccgagagataaaaagtcctgcgggaatagtccttacggcgcttttcttccctcatctccatttctttctgatatccgagcctgtttgccctggactggaggggaatgaccagcaaaggaataaatgcaaataaaagcagcaccgggtcgatgaatataataagcgcaaaattggccaggaaactgattccctgcctaagcacattcagcagcgcattgcttacttcttccgcccggccggagcattctcccatggcttttacaaaggtgtcgtaatacttcggattttcatagcattccagctccacctccgccgccttttgaaaaaccattgtatggagcttctgctttacatctgtcagtctgacaggatagagccgctgccggtaatgagacaccacgcccgctaccgcaatccttacagccatccagataagcattacggccgcaatcgtacgaaatggtctgcccacatttattccattcagcgcaaagcgcagcataaatgtatccgaaacgaattcaacacatgcttccacagccgtaatcaccacagaggaacttaaaaaccatggtgatgccttatgaatcagcttcagaaaaaacagattgttatcaatgatctttctcagggaaaacttccctgtttccattttgtgtactttattcttctgcatactatcccatcccccaaaaggattttatcatagttcctgagcggattgtatttatatttttatagttgataactgtttctattatcttttttaataactaaaagaaatagcatccctacccgcgccgatagcatataacgcagagtctggatgctattctttacattttttcaaaaaggaaaatcaagacctatatttcgctgcacatttatagtatgaaatattcagcagcaaacatacggttccattaaacactatgaaggcttattttatggaatcagaaccattttttctttccagttcttctattcgttttaaagccttctcaagtgcggcagcctgagccgtaatcatctccagcagtttgttattttcttcatcatgccttttctgttcttcctcgtgtcttttctgttcttcctcgtgtcttttctgttcctcttcgtatctctttatctcttcctcatgtttcttcttctcttcctcgtgccttttcttctcttcttccaaggcagcagactgtgcatctatcgttgcctgcatctcgtcaatcatatactgcactgtgttccgatccatctctcttagttcttctgaaaacattcccatcaccttctccatattccggcagacctcatatacgtccccatacatctgtctaaacatcggatatttatttatcagctcgattatccgttccggatcctgcgtgctgtagaacatcagccacgcctccagttcgttttctatgcttttattttccatgtttttttggaatatgtcaagcgtaataaagataaaattctgtaataaatccagctcaagccctgtattaaagctccagtcagatttatgcagatattccttttccatagaatgaaattccacagggcttttctcaaaaagcactatgacatatacgtttttgatgtctttataactgaacttccccttttccctgttcctcttatcccgtgcccttttatactgtctcagcagcagatccgcagcataacaggcgctgcgttctccaggaaaggcgtagcccagcttctgaatctccacatccgccaggcttccgtcctcgaattccaccaggatatccgtgactaataaggtgttttcgtccgcaatcctgcctccttcattgggaagtacctgacggatcactacctttttccccagcagcagagacagaaaacaattcagtctaccgggtgtatattccggactcatgatttccttaaaaaaggaatcgtaaaggatctttacacccttcatacccgtgcagaaatccaggaactcttcctgccgttcaggcatccaactccggaacagcgcctgcagcccgctgctttcatcgatttctttcaacacctcctttctttccctgataagcggaaaataattcctgagcctgttttccataaatattcctcctgtattaagttttttgccatttacggattattgcttcgaaagggaagcgccgaaatgaaagaacggccggacggccggatactacagcagcatagatactgccatgtgacgaaataataataacatactattttaataatatcaactaaaatctaaatgctgttggatatcttcagtacatataagagaataaatccatttgaataattagccatttgtaactgtccagtttcttcacagttactgccaaaatccatcttaaatcgcctacagcgatggaatttccacacatttgaatcattttcgtacgatcgccgcagcaaatgtgctgacctgctgaagttacagctattttaaacttattatccatatttttacagttatttatatccagataatcgtaataacaaaaatagcatccctgccctcatgttatactgctatcagcaatgtttggatgctattctttatatttttttaaaataaatccattgcaatattgtttcctgctgtactcttttaagcattatgcatcctgcagaatacattaagttccatcgcacactatggccacttattccgcagattcagaaccattttttctttccagttcttctatccgttttaaagccttctctagtgcggcagcctgagcagtaatcatatccagcagtttgttattttcttcatcatgccttttctgctcttcctcgtgttttttctgttcttcctcgtgtcttttctgttcctcttcgtatctctttatctcttcctcatgtttcttcttctcttcctcgtgcctcttcttctcttcttccaaggcagcggactgtgcatctattgttgcctgcatctcgtcaatcatatactgcactgtgttccgatccatctctcttagttcttctgaaaacattcccatcaccttctccatattccggcagacttcatatacgtccccatacatctgtctgaacatcggatatttatttatcagctcgattatccgttccggatcctgcgtgctgtagaacatcagccacgcctccagttcgttttctatgcttttattttccatgtttttttggaatatgtcaagcgtaataaagataaaattctgtaataaatccagctccagccctgtatcaaagctccagtcagatttatgcagatattccttttccatagaatgaaattccacagggcttttctcaaaaagcactatggcatatacgtttttgatgtctttataactgaacttccccttttccctgttcctcttatcccgtgcccttttatactgcctcagcagcagatcagcagcatagcaggcgctgcgttctccaggaaaggcgtagcccagcttctgaatctccacatcagccaggcttccgtcctcgaattctaccaggatatccgtgactaataaggtgttttcgtccgcaatcctgcctccttcattgggaagtacctgacggatcactacctttttccccagcagcagcgacagaaaatggttcagcctgccgggcgtatattcagggctcatgatttccttaaaaaaggaatcataaaggatctttacacccttcatacccgtgcagaaatccaggaactcttcctgccgttcaggcgtccagctctgaaacagcgccttcagcccgctgctttcaccaatttctttcaacacctcctttctttccctgataagcggaaaataattcttgagcctgttttccataaatattcctcctgtattaagtttttgcaatttacggattattgcttcgaaaaggaagcgccgaaatgaaagaacggccggacggccggatactgcagcagcatagatactgctgtatgacggaataataataacatactattttaatattatcaacacaaaactaaacgtttttaaaaagcttttccgaaatatcaagaaactgaaaaaaaacagcccctgtgtcagaatttttttcttccccccacaaagcttcagttttccccccaccaccaggattcctgatttcctatgccctttcccgcaaaaactgctgccccacataccatccggaactctttgagagctttccgtctgatatccggggcagcagtgtcctcctaagattgtttatccaattttccgcagatcacatcttctgttctttccataaagaataacggttatcagtaaaacaagcaccgtcacccctcccaggaaaaggtcggccggaacctctgccagcgcaaagcgcagtccgataggaaccagggccagcagcattcctcccagaacggatacaaaagtggaagcgctctgctttactaccgtagtttcattgtcccagttgaataccggcattttcaggttaatggtaattcccagaaccgaagaaaaacacgcataggccagcggaaccaggaatatccagacaggcttcaggcccccggtctggccggaaaccgtcagaatcgttcctgccagcagaatggaaggcacggcaaaagtcagattcaccagcattttaccatccaaaatcaaaccggagggaatgggcagcgacctgagaatccaccactgctttccttctatggaaatggagcttgaggtagtgccccccatcatcaccatcagtgacaaaagaaaggggagcatgcttcccaggctgacaggcagggtgcctcccaccccttccagctgcagatagctttccagcttatccatccccgccgccgcaagcccaatcgctgccgctaccataagtatatatccaaccatcgtattcattacatatatattagaggcaaaataacgctttatctcttttttgtacaaagcgcccagcacggaacgctgcttcaggctctgcagcctgtaattcttctttgcctcatgcgtacgcagcgcactgcttatctgtacatacttccactgcaccaatgcgatgaacaggaggaaaatccccatggatatggccgcaaatccggccagcgccgccggatttgcgccggtaatccccgctgtatacagaccggtcagcggatacatgccgtttacctgctctactgcaccgcgtatcatccccgccatatcctgaagctccatattttccgcccgtgaggaaaaaagcatggttaccgccaggattcccagggtaaaagtcatggacagtaaaataatcaccaaatttttacgccgcacgcgggaaccaatggccatgattaaagttccaatcagagacgccactgtcaggggaaccaatgggacaaaaaagaggctgataaacatccgtacataaacaacaggggaaggcgccgccgtcaggccatataccgcgcctgccggcgctatggtaagcgccgacaaaagcagggagcttaaatacatatgaagcaaacggctcataattatcgccgacggcttcaacggaagggccgtcagcatctcataatccccggcagcaaacagcaccggtcccgctttgaacagggtaaagatgaaaatagccatgctcgacaccgcaaccacaaagccgggaacgctgtcctgtgccccggaaacacacagaacccacgctgcccccgcgacatagaaggcaagcagccccccgcagaatatgaaaatgcacagcatgaaaaccagctttcgttttttccccgcatccctgcaatgcatgacttcattgattccgaagtccttcagcagctgaatccttaacagacggatactcgtgctaatcatgtctgaccacctccataaatacttcctccagtgatttaccctgtgtcagcccggcagtttcgccggcagccaccagcacgccttccttgatgatggcgattttattacacagcttttccgccacatccagcacatgcgtggaaaagaaaatagcgcttccctcctcacaaagggcatgcatattctgcttgagcaccacggaggcggaagggtccagccccacaaagggttcatccagcaccagaagccggggcttatgaatcagtgcggagatgatggccagcttctgcttcataccgtgggaataagaagaaatcagatcgcccaggctttccgtgattccgaactgctccgcatattccccgatccgctccgtccttaccgcagagggaatctgaaaaatatccgcaataaaatccagatactgaataccggtcagatgttcatacaggtccggattatccggtatataagccagaagggatttgcatacaagcggctcctcctttacggaatgcccgtcaatgcggatttctccttcctcaaaatccaggattcccactacagccttaatggtcgtggttttccccgcgccgttgtggcctatgaaaccgtaaatatccccgggcaggatttccaggttcaggttggatacggcttttttcccgcctttataggtttttgaaaaattgatgatctctaacataatattctcctattcttcctgacagttcagttaaccggagcgccgctactcttcctcgcttggagaagagatcaacgtaaaccgcctgattttccggccttcctccggtttgttgtaaatataatcgttgaacaccgcccctattttagcggtcatttccataaattcctcatcggtaagaagcagggtggaggtggacaggctcagcaaatccttcctcgggtcgttctcctcctgtgcaaaatagcgggaaaaggaagcggccagagaaaagagcgccgcctgaatcatctgcgccgcaccttcccggctgtactcccctgccggattttttaccagcgcataggttttttccaccgttccccgtaccttacgctcccgcacgacctcaatcccacctgcttcatacagtattttgatatgccggtacaggctggccggcggaatatcattcagctcttccctgatggaggataccgtgccttcctcatgaagaatcagatactgaacgatgcgctgccttacgggattcataattattttcgtaaaatcctgctggttcattggctcatatcctttctgctgcagtatcaattattatcataaatggtattattatcatatatgatattgttttgttatcctgatagtatcactttcgcatcactgtgtcaagcaattaatacaatgatacaattaacaaaacagaacccttcctatggaaaaagtacggccttccattccccggtacgccatggtaaaataacaataaaacaactctgaacaacacaaaaattttcagcacggagggctgtctgcatgaatgactgtatgatatgtgaaagaattgactggattaaagcagggaaaaacccatattttgtaagagaacttaacacaggctatgtggttatcggcgactatcagcggataaaaggatatacgctctttctgtgcaaagaacacgcaacggagctgcatttcctggaacaagccttccgaatggaatttctccgggaaatgtcccttgtggcagaggcggtttataatgcattccagccggataaattgaattatgagcttctcggagccggaaccggacgtcacatgcattggcatatttttcccagaagatccggagacacccccacaggaggacctgtctggagcctgggcgcacaattgtcagaagataaatatcttcccgcaaaagaagaactggaagcattaaaatcacagcttaacaaagagcttgataaacttttatagaaaatgcccgcagccgctgcggcagacggaggtcgcctgatgaagaaaaaaatatgggaagctgcagtttccctcctgctcatcctctccctcgccctgaacaccgcccttctctttctatgtatggatttgaaaaaacagaacgaactgctacgcactgatgtctcctccatcccccggcagattgacaacagcgtccagctcgctgtcagccagattcaggcgctccaggaggaggaacagaaaatcacctcctattcctccattgaattcggtgagcttgagaacgggaaggctgctgtccatgtcagcactgcgctccgggaaaccacagcggacaccagtgtgcgcatcagctggtcagacggaaacgacggcgggacagtcccggccagtttgtcgcagcagggcttttttactgcggatttatccattcccgttaccagccgcagcgccgccatcagcctgatttgtacccgcgacggtgtggacaccacagaaatcctggacgaaggcctttccgtttattcccactatctgatcgattggcaggcctatggctctcttaactggtcccgcacaagcggaacccagacggccacgctaagcgccaatgtgcaggtcagctgtgatgcccctggaaataaccacggcgtgaaggccatgctgtctctttatcaaaatgacgtgctgctcacctcagataccctgtttgagaatgcacaaggcgtgtccggtgacgccgcttatctcaccacccatgccacactgaaagatggtgacagcttcagcctgcagcttgttatcaccgacagcctgggttatacctatacccggacgcttgaccggctgattgtggaaaacggaggcacacagctgacctccgacccttccctggacagaaatgccggaatgcaggtgagcgcgcccaggtcaggaacctgaactcaggccaaaatccgccgctgaaggcgacttgggataaattccggcagtaactgcgaagcaactgccagttacaaataatctgtggaaaacagacattgcaaagcaccgctgacggcaaggccgatcggcggcgctttttttacataaattccatttcccgcggctggctgcagtttatccccgcctggatttctgccgtttgtgccggcacgcataccattcgtgctgttgctgacatttggcttgtacctgcggtatactttgacaagaggaggagatacatcgtgaaaaagaagaaagaacccctgaaataccatgtttttcaaaacatcacatttttgctgaaatgtatccgcagggagcatccgctgctgcttatcttcatcataatgcaggtaattctgtcggtgatttcaccggtatttggcatctatatcccgaaaatcacgctggacctggtgatgggcagcgcggatacggcacagatttttctggtgctgggaggtttcggcattgtcatggtcctgtcgatggcgttgtcaggaatggcaaatgaaggaaagtacatcatgtacaatgatatgcgccgctattaccagatggagcttttcctgcagtccttaagctgcgattacaaaaacgtggaaagcgaagaaggacagacgaagtatcagcgggccatgtcaacactgcgtaacggcgactggtcgggcacctccattatgatcgtttcctccattgacattgtggtgagcctgttgtgttttttcatttactccggaattatgtcttccctcagcccctatatggtactgcttcttatcgtgctgtcgctcatcagcctgtttggcaccaggcaggcgcaaagctatgagtataaacagaaagatttaacggcggcatatgaaaaaaagctgtcctatgttatccgtacgggaagcaatgcagcgttcggaaaggacatgcggctctatcatgcaggaggctggtttcaggagctgcgcggcagcctgatagaggaaagtgcaaagctggcgggcaaaatccaggacagatatttcgcttccggcgttgtgaacgctttcgtccttttcctgcgggacggcatcgcctactcctatttgatatacgccgtttccgcaggacagattacgataccggagtttaccctgtattttggcgctgtcacggctttttccggctttgtcaacggcatagttaacaatctcaacgagctgaacggcgctaatctgcagatgaattccatgcgcgcctttctggataataccaatgatccggaaccggaaacgtccctggcactttcggatttgaaagaatattccattgaattttgcgatgtctgtttttcctacggaacggataccggcttcgtgctggatcactttaaccttaaaatcaatgccggagaaaagatcgccctggtaggcgtcaacggcgccggaaaaaccacggtggtaaagctgctctgcggtttttacaaacctgattccggcacaattttaatcggcggccaggatataaacaatttccggaaaaaagatctgctgaagctgtatgccgccgtttttcaggacatctatatcccgcccttcaccgccgccgagaatgtttccatgcaggagctgaaaacaacagaccggaaccgcgtggaggaatgtcttgtcaaaacagggctttgggagcagttttgcgggcagccaacaggcattgacacccccatgacaaaggagataacgggcggcatcgttttatcaggcggccagcagcaaaagctgctcatggcaagggcgctttacaaagacgcgcccatcctgattcttgacgaacccaccgcagcccttgaccctatcgcggaaagccggacctacgaacaattccacgaaattgcatcggataaaactgctgtctatatctcccaccggctggcctccacccgcttctgtgacaaaatcgcatttttaagcaatgggaaaatcacagaggaaggcacacacgacgaactcatgcaaaagggaggcgcttacagccagatgtttgcactgcagagccagtactatcaaaacagggaggtagcggagacttatgctgaagcataataaattaaagcctgtgggcattgcgatcagacttatgtggaacatggataaatggctgctcattcacagcataatcacgtccgtaattgaagcggcaaccccttttgccgggattctcctgtccgcctatatcctggacgggctgcaggccggggaagaatttactgaaatcatatccgtttccctggcggctgtagccgttattttcctgctgacggtgctgaaagcttatttttccaaaatactaaatgtacatatcggtatgtgcggcaaaagatacgataccctgatgagcatgaaaaccatttccatggattatccgctgctggacagtcctgccgtaaacgatatccgcgtcaggatccggcatgacaacgactggggcgccggcttttattcccttgtatggcagctgccatatctgctgaacagcctgatatccaccttcgtttccgtagtacttatgctgccgttatttatggaaggacattttttctcagataccccggcaatactgctgcttctttcgctgggcgccatcatcgccttcaacctctggtttacctctgttaaaaacaaagagctgtaccgcctgctggacgatccttctctggataaaagctatcttggctattttttatggaatgatcaggattaccattatggaaaggatatccgcatctatgatgcaaaaccactgattaaaagtaaacttgacggggaccttgtgataaagaaccgatggataaaacagctggtaagcaacaacatgaaatccggctttttcagcaatctgtccgccggaacgcttcaaatcatctcgtatattttcgtagcgctccgcgccgcggcgggagcgctgactgcgggagccgttgtaaaatacgcaggcattatctaccgtttttcccagtcggtcaccaacgtcttcaacgcgctggaggaatacgctgtctcctccaaccggcagctttccacgctggaatatctgaatatcaaagatgtgctgaaaaaaggcacgcttcccgtggaaaaacgcgccttctgtgacggcagcgacaatgaatatgaaattgaattccgggatgtatccttccaatatcccggctccgatacctgcgccctgcgccatatcaacctgaaattccgcgttggcgagcggctggcggtggttggtatgaacggctccggaaaaaccacctttatcaagctgctctgccacctttacgatcccacggaaggagaaatcctgctcaacggcattgacatcaggaaatatgattatgaggaatacatgaaaatcttttccgtggtctttcaggatttcaagctgttttccttttccctgggacaaaatgtggctgcggatatggattatgatacgaaacgggtggaagcctgccttgatgcggccgggtttgataaccgccgtacctccatgcctgacgggctgaagacatgcctgtataaggattttgaggaaaacggcgtggaaatctccggcggcgaagcgcagaaaattgcgctggccagggcgctttataaggatgcgccgttcattgtgctggatgaacccaccgccgcccttgacccaatcgcagagtcggaaatttattcaaaattcaatgatattgtgggaaacaggaccgccatctacatcagccaccgcctgtcctcctgccggttctgcgatgaaatcgccgtttttgacaacgggcagatcgtacagctggggagccatgaggaactggcggcagataccgggggaaaataccatgagctgtggaatgcccaggcgcagtattacagcagttagaactatgactctgcttccataaaaaagtgaagcaaaacaccgttgcccggaggcagcggtgttaatttttacagatattctgccgttgcggtatgaccggcccgcttcagctcctccggcgttccttcaaacaggatacatccccccttctccccgccctccggacccaggtcaatcacccagtcgcagctgcggatgagctgctggttatgttccaccacaactaccgtatttcccgcatctgccagccggttcagaagcaccagaaaatgatcgatatcctggggatgcagccccgtagtgggctcatccataagatacaggcttctccttccctgaggcgttcccacaagctctctggccagcttcagccgctgtccctcgccgcctgataatgtggtaagcgactgccccagctgcagatatccaaggcctacagcctgaaggagactgagcgttttcctgattctggcctgttcagcaaaaaactccgcagcttcatccaccgacaaatccaaaacctccttaaccgaaaggcccttatattttaccgctaggatctcttctttgaaacggttccctccgcagaccggacagaccacctgcgtattggcaaaaaacagcatattgttgtccacataccccagtccctcacaattcccgcatctgcccccggccgtattaaaggaaaaatgctttgcagaaaaaccggcgtttactgcggcctgcgtaccggcaaaaaacgcccgtatctccgtgtaaacctcagtataggtggccacattcgatcgcttcatcctggaaattgacgcctgcccgatttcaaccacccggttaaactgttccttgcccagcacccggtttttctgtgtatccgcccttcctttggcaagcacctcaaagaccagcgtggatttaccggaaccggaaggcccggttacgctgaccaggcagcctgtagggatatccacacaaagctgctttaaattaaacttgtccgcattttctattctgaccgccccggccggttttctgtaccgtgtattccaggcgggctgacggcacagatatcttcccgtcacactttctttttgttgctttatctcctccagcgtcccttccgccacaatttccccgccgaattttccggaaccgggaccgatatccacaaggtaatcagcagaggcgattacatccacatcatgctctatcacaagcaccgtgttatccaaatcccggagccttttaagaattgccacaaggccggccgtgtccttgggatgcaggccggccgtaggttcatccaggatataaatcaaccctgtgatctccgaatccagtgcagccgcaagccgcagcctctgcagttccccgcccgacagagtaaccgtctgcctgtccagggaaagatatcccagccccaccttaaggaaacggctgatcttggtttccatatcggtcagataatccctcacaaattccatctgtttttcatccagggacgcttgcagctcccatacccaggcatacagcctgtccagggaaaaaagtgacagctgcggcagacggagcccctgcacagttaccctcctgctcagctcacaaagccgctcccctctacagtcgggacactccttcacctcaaagtaatcctccagctgttttacgtccccgtccttatccgccagccgccgccataatatgggatatacgccctcaaacctgcctgccgccgtattcttaggcggcgtaatatgggggaaggcctgttttacttcatcactttccactccataataaagaattgcctttcttttatcatcaaactgttccaccaacgtccccggctccacaggaaccccataatgggaaaatgcctggtgaagcacagaaagctggtatttcccgtactgcttttcccagtattttaccgcgccgtcctccaaagacagcttctcatccactgtccgttctttttttatggcatgaatcctgcccagcccttcacaggttgggcaggcgccttccctggtattgaaggaaaaatatgtgcgtgttatcttatccatacgcctgccgcatttacagcaatacatgtacacataaaagtcatttccttttttctccgtctcctccctgcagccggctgccgaaatcagctcgccgcagtaaggacatctcctgctgcccagcttttcataaaccatacgcaaatccgtataaatatccgacatggtgcctaccgtggaacggggattcctgttcgcatccgtctgggtaatcactattgccggggatgcgccccgcacgcgttccaccttcggcttatgaatgccctgaaaggccatggcttccagatactgcctctggcattcattgtagagaacatcgatgagaagcgtggatttaccggaaccggaaaggcccgtaaataccacaagcttatttctggggatgtccagcgaaatatttttcagattgccttcggcggcgccgataatactgatatctgacatttggtcctccttggttgttgaagatttccagaagtgctgcattctgaagttactatgatgtatttcaagtattgccttccctcccggaaagcgccgccatttttccactcataagcctgcccatcctcaatgagaaaagataacacagctccatctgcaccttttgaagaaagctatggcagataacaaagccttttccattgatattctccgccagcccatatcccacggttttaggatccgccttatattccgcaggaaaagggaacggagccgaggatttcgtccgcgtaagcggcggatggagaatatggaaggttatcccctctttctcatattccaggctcagacatttagccagcgcctctactgcgcctttgctggatgcatagggactgatattcgcaaaccccattacgcctacgccggagcttgtaaataccacccttccgcagtgctgtgccctcatgtaaggaagcactgcccgggacagccgcagcgcgccaaaatagttcacgtcaaacacttcctgataaatctcatcagccgtgtcggccatggaatcaaaggtacaccggcaggcattatggatcgcaatatcgatggtctgaaaggaagctgcgatccggttcaccgtttcgacaacgccgcctgcgtccctcatatcacagatacagtcaagcagcctgccgggatactcctttttcaattcccgcagattgtcattttccagatccagcactgcaacgcagtccccgttttgaaggaatttctccgccataaaatacccaattccctgatttccccctgtcaaaattatgtttgccattcagacgcctcccatttctttgaaaaattccgtgatatgttcctctgctttttcaaggaaaagctttttcttagcttccgtcagttctcctcccaacaggtatcgctggaaaaaaagataaatcggcgcgtaatatttcagcgccagatattcaccgtccgccgccggaatccattttttctcaattaatgcattaaatatcctttcctgaaacctcagcggttcttcgaaaatccatttatcatatgcctgcctcatagcctcgctgccgctgcgctccatatgcaggagcctgatatagcgattgcagaaatcatccatcagataatcatggaaaaaaactttcgctgccgcgccgccggatataccgctcccgccttctccctgcagctgcgcaactgcgtcgtccagccgctgcatcagccctcccgcaatcatttcaaaccgatttcccagctcctccaaaatagcccgtttattcgtaaaatgatagtaaacagagctttctttaatatgtacctgcccgcagatatcccttatggatacagcgctgaagccatactgagaaaaaagctgcaatgaaatatccagaatccgttcctttgtactgtctgccgccatccttctcccctcctctaacaactgttaggtgcattatatctaacattcgttaggctgtcaacaaaaagtataactattccctttcatttatgacaaaattatgataaacttaaccaacaccggcagccggataatatgtgtaaatcctatctgcccaaatcaccttttcttcctcttatcaaatgaatttatctgtccagtcggacaacatttcattttattctttatttccactatatatttaaaacaaaagaaaaagtaagaatcggttgtccggtgtcggattttcagttataattgaatggaagatagacatttacacatggcttacaggaaaaggaggccgtgtgcagcaagaacaaaaaaagtctgaaccacagacggagtccaggaatcttcatcatgaggatctggccctgaagaccgccgcgcagtattttggcgaggaactgatgcctctgctcggaattaccggcaaagccaaatatgttgccccaaccgaactgataaagcttgaggcgcggcagatgtaccaggatttcaactatgtatcggcagataatacctggatccatctggaatttgaaagtgattccatcacaacagaggatctcagacgcttccgggaatacgaagcaaccaccagccgtacctatcatgtccagatcatcacctatgttatctgctcttcccaggtcagaaagccgataacaaagctgacagagggcatcagcatctaccggataaaagccgtccgtctgaagggccggaattcggatcggctattcgctcttctggaggcaaaagaaaagcagggagttcctcttgagaaagaggatttggtcccgttgcttttaagccctctgatgtccggacgtctgacgattggagaaaggatcgtaaaaagcctgcattttctccaatccgccccaaatgccgtaacgaaaacggaactggaaaaaatgcaggccgtaatgtatacgttggcgcttaaattcttaagcaaaaaggatttaggcaaagtaaaggagatgatatttatgactgaactgggacagatgctggtcgatgatggaattgaaatagggctggccaaaggcgagtcaaaaattgtagccatgatacgaaaaaaactggcaaaaggcctcaccatttccgccatatccgaagaattggaactggacggcacttacgtccaaaaagtaatatccctgatatccgaagatgcctcaagaaacgatctggaaatagccgaaatcctcatcagccagaactgatgaaataagaacgtcaaacagcggctgcccgcatggacagccgccgttttccataataccagtcattcttttatgcccgccctattcttctccgctcacagtatcataaggccagtccataattcctccaaaatcataaatctgcgtatatcctgcctccaccagctttttcgccgcctgggcgctgcggttgccgctcctgcagtataccaggatctccttatctgtatccggcagctgctccggcttaccgtttccgatggtttcattgggaatcaggatagcacccgggatatggctttcatcgtattctgcctgtgtcctcacatccaggatgataatatcatctcccgaatccatcctcttctttgcatcctctgctgatattttatgatattccgcccgcattgtatcctcctgttctgtctgcccactctcacccggcagcacgctctgtcctgcttccatgccctgttccgcttccataccctgttctgcctgcacgccctccgccatttgctgcgtttccaccgttccgctctgcttcccggcagctgcgcatgcagtaagcgtccccgcaatcacacctgctgttataatacccgccagcctttttttcattcttttcttcatgcatttcctccgtttgctgtaccggttaacctgttatactgtaattatattaattacagttatatttgtcaaccctttctttttccaggcaaaactataagtaacagttcagccttcggctgaactgttacaactataaccatatttccgtaacttttccattccttcacagttactgccaaaaatgatatacttcagacagaaactgctgctgcaaaatatttttaaccggccctttttaatattactttcattattcccatgcataattaaaaataagcatatacatctgacaccattaataaaaaaaggaggctcccatgcgcttactggttgcagaagacgaaaaggatctgaacgatgtcatcacaaaaactctgattaaaaaccactactctgtggattcctgccaaaacggccgggaagcccttgactgcctggccatggctgaatacgacgccataattctggatatcatgatgcccgggataaacgggctggaagtgctgaagaagctgcgaagcgcaggaaataaaacccccgtgctcctgctgaccgcgctggacagcgtgcccgaccgtgtagccggactggatggcggcgcggatgattacctggtaaaaccctttgccttcgaagagctgctggcgcgcatccgtgccatgctgcgccgtgaaggcggccgaccggacaactgctaccggattgccgaccttgttgtggactgtgatgccaggaccgcggcccgcggcaacgtgcagatcaccctatcctccaaggaattctccatccttgaatatctgatctgcaatcagggcattgtcctgacccgtgaaaaaatagaacagcatatatggaattacgattacgaaggcggctccaacgtagtggatgtctacatccgctatctgcgcaaaaaaatagacgacggcttctcccccaagctcatccatacggtccggggcgtgggctacgtactgaaggaagcttaaaacgaagcagccagcgaaagggatacgatgaaaaatttatccataaagcttaaaatcacactctggtataccgtcttcatgaccatcctcataatcgtcatactctggcttcttttttccatcagcagcagccaggtgctttccaatgcccagctgcggctgaaggatacggtaaccagaagctttcatgaaatagaatatgaggacggcgtcctggaatttgacaaggatatcaatttcctgggagaaggcatctatatttccgtttacagcgcgcagggcgctctgctgtatggccggacgccttctttattccacggcgcccccatgcttatcatggatgaaatccagcaggtgacctccggccagaatctctggtatgtctacgattactgccagaaaattgacggctacggcaatctgtgggtacgcggcatcgcctcccagacacagacggatgccgccctccatatcctggtgcggctggcgcttattttcctgccgtttttcgttctctgcatcgcggcgggcggctacctgatcatccgcaaaacccttgcccccctggccgacatgactgagactgcccggcagatcagcgaagggaacgacctctcccgaaggataagggtaggggaaggaaaggatgaagtccacaaaatggcccataccttcgaccgtatgatggataagctccaggcctcctttgaaaatgaaaaacagtttacctcggatgtctcccacgagctccgcacccccgtagccgtcatcctctcccaatgcgaatatgcttcccgggaagataccacccctgaggaaaccagaggctgcatccgggccataacgaaccaggcccgcaaaatgtccaacctgatttcccagctcctcaccctggcccgcgcagacagcggaaagcagcagctccatcccgaaatcctgaacctgagcgagctggccgaaatcataacggaagaacagcgtagccttgctgctgcaagaaacatcacactggaaaccgatatccagcccgatatcctgttttgcggagatgaaaccatgatgatgcgccttttcatcaacctgatttccaacagcatcacctatggacggcagaacggccatacgctcattaccctttcctccggcagcggatacattaccggctctgttgccgatgacggaatcggcattgaaaaggataagctggataaaatatggaaccgtttttatcaggtggattccgccagaagctccggggagcggcagggttccggcctggggcttcccatggtcaaatggatcacgcaggctcacaagggcacaattttcgtggaaagcagtcccggagaaggcacccgattcacgtttacatttcccgcgcagccaagaaatgcggaaaagtaacgtctccccatagccgaacagacagggggcggcacgaagatgtgccgccccctgtccagctcctgtctgccacatgtttttcacccggtgcctttacatctggtgtattcccctctgccgctttatcccataatcagggaaatgagcttcggtatcacccccaccagcaacggcacaatcaccggaagcagccatgtaaggttcctcaccagccagtttccttcgccccgtttcagatagcctgcctcttttttataatattcccccttcttttcatcatcaaaatacatatcataggcagggaactgaaacagcgccaccacaagcaggccgcttaaggtcgccagaaaaatcaaagcgccgttctcccatccgcccatcagggcgatcgcataaaagcatggccagaacatataccacagcgactgaaaccatatcctgcgcaaaatccttttattcgcctttacctcctccggctttgccacctccaccgttttcctgtaatcctcatagagccgcctgcattcattacaggtttccagatgctcctctatcaccgccgacgtttccggcgaagtcagttcctccgaatagttaggcagcaaatcctgtacaatattacaaataacctctttcatacttcagcactcctttcccggccggccgttttccgcttcctcaagataccggatcagcctgcatttgtcccgcataaaggtcacacgcgcccagttttctgttctttgcagcacggtaccgatttcccgaaaggaaagctcattgaccagccgaagcgtcatcagcgaacgatgcggctcctccagggcatttatatacgaaaaaaccctggccgcctgttccctcttctcatactgctccgccacatccgcgccgccgtgcgccatttccttccagtcctcccgcagttcctctgttgccggatttgcccgcagccagtgaaaatactcgtgcctggcaatggtaaaaatccaggtttttaccgggcagcttccccgaaacccccgaatccctgaaatcaccttcagaaaagtactctgacagagatcctctgcaacatgcggattgcggcacatatacagcaggtacctgtaaacatcaccggaatattcccggtacagactttctacttcgttttgcccctgcatgttccgcagccccctttcacttaattagagtctccggaataatttttgttacatcggcacgcaaaattttttcctctcatgcaggtaaaaatattctccggcgaactgtatccgcgtgggggcaaaatccggctccttcgaataaatataatagcagcagtccctgtctgacagcacgatgcaggctccccgccctctgtaattatattctgtctgcacggactccctggaaacatggtcgaacacaagcgtcttaccctgcaccgaaagcgtaaaccctttttcctcctgagtcagcctcccctctcccatagggataaaaccggaggcattgggaagcgcttccacacggacagacaggtcacagcggtactctccccgaagaatttcctcctccacgttcctgcgctgccactcataccagtcgggaatcctctgtatttcccctccccgttgcagctgcccgtactcgtccatttcccactccgccccacaggcggaacagcgcagcacacagccgcagctctccatacgaaaagacgttttgcaggcccggcactgataaagcgccatatgaagcccttccgcccggtttttataacggatggcaatccccttttccttctgccagcggtattcgtcatactgtaatttttcctctattttctgctgaacctcctcatccccggccctctccagctcctgtgccgtgtaaatacaggtaagcctggcctccatgggcaccgtccttatgtgctcttcgtcccagaaggggcctgcaagatagcttccgtgaaccgacagcgtcaccaccggcaccttcatcagtttggccagcttccccatatttcccggaatcctggaggtggttcccacattggaatgcctggattccgggaaaacagcaacaatctgctttttgttatgtaaagcgtaatagatgttttttactaccgccacatcggaaacatatcttctctttccaatacagccgatgccccggtacagccattcgccaaaggccgcgaagccctccatatccgatacataattcgcacggtgagggaacagtgccagcggcgcaatataataatcggaaaaaccctgatgcgtggaaagcacaagatagggcggccggatatgctccatattttctttctcgattttcagcctgaacctcctggtcatcagccaggaggcgccccaaatgagcagcaccagaaacggatactgctttacgggcttcttattcatgtcaaacggtttccagtttttctttttattatgaagcatgattactcctttgttatgtccttgccatgcgtccccggtaccagctacggcatacggggccaaggctctgcgccgtcgatttttccattccaatacatctgaaaaatgtaacaggtcattgttctattttaacatacgcctgtaaataaatatactatctcaaaaaacagccgatttaaaacaaagtaattctatatccctctaccttcacatacaaattactaaataatatcgatactttttcccaggagaacatctcatgaacaacatcaaatacagcatctgcagcaaccctgactgcattccggtaatacactccaactggtatcctcccatcgccgttcaggaaaaaaatccacagtacgcccagttactcatgcctgacctcgcctctgccgccagtgaaatgaccaccgtgcacacctatctgtaccagtcctggactatcggaaatgattatgaaaccattcgctgcgtcataaaacgcctggccgcggtggaacagcgccactatgccatcatcggccagctgattgcgcttcttggcggcgaaccggaatgccgttccacaatgaacaactcctactggtgcggaaatatgataaactacagctgcgaccttcgcacccttctttccaataacgccaaatcagaatgttttgccgctcaggcatatgcagaacagtcgcaggaaatcaaggatccctgcgtttcaaaaatgctcgcacgcctgtcgcttgatgaagagcttcacgttcaaatattcaatgattttttacagcagatttaattgcccatcccttttctgcaggctgcgattaaacaataattttttctcctttttaattttcctttaatcttgacattataagattagtttaacaaaagggaaaataagaaaggagttcattatgaaaaaacatttatttctactgccttgtatgtttggaatatcagcagtcctgctcacagcctgcacaggccgggacaacgaaaatacagtaactcaggaaatcaccactacccaggaaacattggcggcaggcgcttccggctctaccgtttcagtcacggaaaagcaaaacagcgatacgccgcttcctgctgcaggagacagtgttcccatagctgacagcggaataaaggccgcagcagccgcaggcggaggaaccgaaggccaggctgcttatatcagtgaagaggatgcaaaaaaaattgccctggagcatgccggccttaaggaagaggatatttcctatttcaaaatgaagctggataccgatcacggcgttacagagtatgaggttgaatttgtttcagggaatacggagtacgattacgacattgatgctgttaccggcgcaatccacagctttgattttgaaacccataacgggcattccgccagctcttccgcatctggcgaaaacgccgccctcccggccggctccataagcgaagccgacgccaagaaaattgcactggaaaaggtgcccggcgccacggacagcaacctgcgcatcaagacggattatgatgatgggataatgaaatatgaagtgaaaatcgtctacaatgaaatgaaatatgaatttgatattgatgcggcaaccggaaccatcctggaatgggaatccgaatcagtgtacgactgataaggctttgcagaggataaccattatcccataacaggccggtggtatcggataaccggcaccacaatcaatgacttcaacggagccggcccctgcaagggcccggctccacatttttttctgctaaaccagttttatttttccggagaaataatgtatttccccttagcacgaatttcaggcctgctcagaatatcctccagacgatccagcccacacacctcagaaaccatgctgctcacatcaagacgtccggaatcaataagttccagcgcccgcttctgggtataaggattgatataggatgccttcagcaccagctctttctgaaaaatctgaaatggtttaatcgctatcgtgtcttccggctttgtcagcccgaacatcattaccaccgctttattcccggcaatttcaattgcctgttccatggtggagagccttcccacacattcaatcaccgtatttatccagttcattcccgcagccgccagcgcgtcctttacattctcatgcagcggatcgatgcacagatccgcgcccagccttcctgccacctcacgctttccttccacaggctccagcagcgctactctggctgccccggccagctttgccagctgcaccataagaagccctatcatgccgcctccgataaccaccacctggtgccccggcctgatttcacacatatccagaccatgcaggcagcatgccgccggctccgccatggcgccctgctcaaaagaggtattttcccccagccggtagacctgacggcaattcaccgcacagtactccgcaaagccgccatttacggtcgttccgtatccaatcatatgctcacagaaatgtgccgccccgtttctgcaggcttcacaggctccgcagtagcagttgggatcaatacagaccctgtctccctccctgcagttactgacggctttccccgtccggactaccaaacctgaaaattcatgccccagtatcgtaggcggcgttacttccgcagcccccttgtccccttcataaatatgtacatccgtcccgcacacaccgcaggcctttacctgaatcagcacatcctccggtcccaccacaggcatttcatactcttcaagcctcaaatcatgttttccataaaaaaccgcacttttcattcccgctcccctctgcgcccccggcgcgctatccttttctccaccggcctttcaaagaccttcagtttccaaaatctttgccagcgtgccgtcctcatccagcaccaccgtcattccttccgccagtccgcgttcctccaggagcttttcctccatcagcatggcaaaaactttgtctttgcaccggctgccatctccattttccggcagctccttcaggaatacccggcaggccgccggcctgccctccggccgttcctcacagccaaaatccggatcttcaatccggcagatcacggcccggttgtgcttcatgaaaatctgatctttcagaaaattgaccagcttttcattgacggagtcgttcacccgaaccgcttccagaccttctcccagaagttcaggacattccccgcaaatatcaatcccaaggatcctgtgcctgcgaatcaggatttggagaattccctccagcatggccagactcatatttccctgatcccagtccgtaatctcctcctttggtgaaagcacatccttatcaatggatataaaaacagggagccgcacatgcgcctgggcaaatgcccgccagtttttctccataccaagcgaatccgtagtaaaacaaaccagcctgtcgcggtatgcttcatcaatatggtccagataatgcttatccgcgccgattatgaccactttccggacaaaaggattttcatccagcacatccttcacccaggaaccgcagctgagcagctccccaaaccgggaaggctgcatatccgtatgatgatcaaacaggaccagcacgaaatcctcccgtatcctgtccgtccagaacttgctcacataatgataatttccggaatcaataaaatgcagcccataaggagacagcctggcaatccgttcccggatgtcctttaccgcattttcatcgcagtacccgttcacaccctccagatccgtcagatcaatccagcagtgcggttcctttttatagaagctttcctgctcatacacatgggtaaaattcatcaatacaaccggcgttgtgtccggcgcttttttctccatacttttccctccccggatggcgctgccaggctgaatgggtgaatttggcactaaaccattttgttgaaaatctccatatccactgcattatcctgcctggccacaatggtggtgcagaccgcatcccctgtaatgttgaccgccgtcctggtcatatccagaatcctgtcaatccccataatcaggccgattgcctccaccggcagacctacggaattaaaaaccatggacagtgtaatcagccccacgcttggcacgcccgccgtaccgatggacgccagcgtggccgtagcgattaccgtcaggaaatcagctgcgctcagctggatatggaaggcctgcgcggcaaacaccaccgccactccctgcatgatagccgtgccgtccatattgatggtggccccaagcggaatcgtgaaggaagaaatctttttgctcacgcccatcttacggtgaagcgtatcgatggaaagcgggatggtggcattggaggtcgccgtggaaaaggcaaacgccataaccggagcgaatttcttcaaaaaacgcaccgggctgaggccggtaaacagcttcagcagcacctgataaaccacaagtccctgcagcgccagggcaagaaacacagccagcatatatttcagcagcggcaggaaggcatccagccccagcccggcaaaggttctggcaatcaggcagaatactcccaccggagccagcttcatcacccccatggtcatatccatcattatatcattaaactggctgaaaaaggaagaaaccgtatccgctttttctcccctgtgcgcaagaatcacgccgattatcagcgcaaacagaatgataggcagcatctccccgcttgccagcgcccccagcggattggttgggataatttgaagcagggtatccgccatgctcagcttttcccccacagcagtttccgtagtctctatcctccccatatccagccctgtccccggattgatcaggcttgccagcaatatggctaccgtaatggcgatagccgtggtcaacagataaaaagcaatggtcttcataccgacctttcccagccgcctggtatctccaattgccatgctgccgcagacaagggagcagaaaaccagcggaaccaccagcatctgcatcagccggataaacccctgccctatcacataaaaaataccgttgacaatcacctcatccctcacatacccctgaggcgcccaaagattcagcgccagccccgcagccgcccccaaaatcaatgctataaatataatggttgtcagattccgtttctttttcttcatcgatcctcttccttttgcaatcgtcccgattacggaacggttacttctgtttacagtgttgtcacagccgcccggcatcctcaccgccgcgttttgttcatataggcacgaagcgcctcttcccaggataccggaagctcaatgtcatccaggcgcagcatcagattatccagcaccgcataggacggatgaccgttttccccggcgctgtccgccttcaggatttccgtatttttccctgcaagcgtaaggatgcgcctggcaaattcataccggctgcacacaccgccgcagaccgcatggtacagaccataggcatccttttccagcagccggtaaatcacctttgccacctcatccgcgcttgtaggcgctcccagttgatccccgggcacccttatgcagttttccgtttccgctctccgcaacagctgcgtcacaaaattttccccgtctccgtaaacccatgagctgcggataatcaggaatttgggcgcaatggtttttacaaactcctctccggccagctttgatttcccatataccgttaccggcatgggcgttgaaaattcgttataaggctccgaagccctcccgtcaaaaatatcatctgtggatatctgcaccagctccgcatgcacgcttctggcggcaacactcaaattccgcgcgccgacggcatttaccttataggccagatcgctgttttcctcacagaacgccggaccgcagattccggcacagttaatgacacaatccggcctgtacatttcggcatagttcctcacagcgtccatatccgtgatatccacctcgtcaatatccgtaagaagcacatccagctctgttgtatcaagcatcctggcaaaagcgcttcccacctgcccctgtgcccccgttatccatattctctcatgttgcagcagcatatcaatcctcctagttttgcggagcaaaatgcgagccctctggcgagcagaggattttcctcctagttttgcggagcaaaatgcgagccctctggcaagcagaggattttcctttttgctttgctccggcatgaaaagactcaggcgtattttatcgtctgagtccgtatcttcctgaaacccttttatcgtgagcacagatttgatggccttcctaaccgctttatcacagcataaacgctcacaataaaagtttttttgaaagtttattataaaaaccggaagccaaaccgtcaacagaaatccaaaaaattttcctgataaaaatttatttacatctgtttctagtattctgccgttttacataaattatccagtatcccggcatctcaggccacttctggcttttttcaccgaaaaacttatcccaattattcaatttttctaatttcatatcgtaatatccagagcttttattttcgtgttactgtttctgctctcatgttgccatttacagaactaccctgtatactgacattacatttacaaaaaagctgcgtgtattgttccgcctgctacctctactacaaaaaaggccgttgtataaggcggaacaaattttcatcaattatgtaccagcaagggaggaatttctatgatttatttgaatgaaaatgacattcttatccgggaaatgcgggaaccggatcctcaaatcttcagtgatgaagaaatcaaacagggctggcatgcctccccggataaatacaaaatgcgtattgccgatcaggaaaaaggggactgcctcgctctgacagccgaatataagggcgctcccgcaggctatatcaatgtctactggaatccgcctgccggcgcttttgcaaacaggaacataccggaaattgttgacttcggcgtcctggaaaaataccgctgccgcgggatcggccgccgcctgatggacattgcggaaaagctcgccaaaacccgttcggataccgtatgtctgggtgtgggcctccattccggctatggcagcgcacagcgcatgtatgtaaaaagaggttatgttcctgacggcaccggcgtgtggtatcagaatcaaatctgtgtgccttacggtaattgctgcaataatgatgatttggttctttatctttctaaaacattagaatagctgccaaaaaacgttacataaatccttatgtccgttcccacggacgcgccgataccctgtcagaatccctgaaacaggaaatacaaagctatctggatatcgatttgaatgattggattaccgcccaaggagaaacaacatgttagaaaaaaacataaacagtaccaaaatactggaacaaaataaaaacagctgggatgctatggctgactcctggtttggaaacacagcccttccctgctacggctgccttgtcccttcagaggaagatctgcagttatttcctgcccttttcggaaaaaaagttcttgatatcggctgcggaagcggccattccctgaaatggtgcaaagaacatggagccgaagaaatatggggccttgacatgtccaccagacagcttgaaaatgcccgtacctatctgacacagtcaggatatgagcctcaccttatcaacgcgcccatggaatctgactgcggtcttcccacagactattttgacgtggtctattctatttatgccctgggatggactgtggatttgaatactaccatagacaggatttcctgttatttgaagaggggcggcattctcattttttcatgggatcatccgcttatgcactgcatcgatgcggagggggaaaagctggtactaaatggctcatatcttgatgaaaatcctttttcctatatccagcgcggaaatcctgtcaccattcataaccataagatgtccggctggatcaatgccctggctggtgccggctttaaggtggaaaaacttgttgaggaaacggacgccgaaaccctttcccaggaatatgaattttcggattcctactattcgcctttcagggcaaagaaaatgccgctctcttttattataaaagcggtgaaactgtaatcccgcttcacccctcactgcaaccgccaaacggacagcctggaacgcatattcctctttccgaaagaaaatcaaaaaaatggccgggatccttcctttctccggccatttctctctattccactatgcaggcatccccatctgaaaagcacctacaggattacacggcaagattacacatatcccagcctggacagaatattcttcggctgatcaataaaaaccatatccgcattgtcatccagataatggctccgctgatgtataatcacaagatattttccctggaaatatttgatatagtgggaaaatacctccgaattcagattggttcccagtaacagcagaacctccgcccggttaatctcctccaccgcctgcgttaccagctgactgtccgccatttcccggaagaaaaacaaaccggggcgaatgggaatctgacagtcctcgcatacaggaatcccatgcgcctgtttgatatactccacaggatactccctgccgcaccgttggcagatattatggtaaatacttccgtgcagctctattacatttttacaaccggacctctggcacaactcataaatgttgcttgtaataatacactgaagcttcccatcctgctccatcttttcaagcacagcctctgattccgtaggctccgggccgccgttcagcatctcctgcttatagaaatcgaaaaacagcttcggccgcgtattataaaacgcactggtaaaaatctcttccggcgaatatccgtatttcttttcaatatcatacgctttgtccggattttttactccgatatatcccccttcttccatcattcccgatccgcacagggctaccgtatagctgctttcatccaggattctgcgcaaagtggctattctttcctccatctattacctcctcctctggcttctccgccagtttttctcagcataatctgtttgcagcagttcagctctccattctgctgcgactgtttctattatactattatttcccgtatttttctatggattacacagtaaaagaaaaaactgccaggcccggaaaaaactcccggaaatgacagcttctctattatagttcaaacaggttgcataccgtccggaacatttcatcaattccaatacttccgtccgttaccaggcaggcataccctctctgctttgcatccgcatgcaccgcttccgcaaaaagcgcgtctctctccatccagttttcaaaagcctttttcttatctgtacagccctctaaaatatagggaacccagggcctctggctgtaaaaatggtactggaaatccttcaccggaacaatattgatataatgctttttgtccactcccacagcagaaacgagctccggcaaaaatgccgctccttcggttatgattttctttttctccggaaaagtgttcaaagcttcccatatatatgtaaaaatctctctgtagatttccagctcctcctccgtctgtaaccgggggctgcgcatccaggtttcctccggggacatctgcatggcccttgcagaaagcggcttcccatcctcctgtgcctttttcatatactgttccagataatcgtccaccttaaagtagttaaaatcatacttttcggcaatcatttccgctatggtgctcttgccgctgcaaggagagcctccgataatatataatccttccatatacctctttcccttccggataatcaggccaccgccgtttccgtttaaatcagatgatttttatctccgcttttttcctggcaggcaggtaacggtaattctgacggtcgggatagcctgccagcagcgtcccgtatacttcatagccctccggaatttccaggaccatgcggcattccggaatgagattcaggaaacgggtaagatagccgccccagcaggtgccgattccctcagcctggagcagcagctctgccgtagtcagggctattgccgtatcctgcgcgggatttatggaatttctccggcatattccgatgataataaccgcattttctcccattaccggattattcccattggcatattccgaaatcagttccatggaaacctgattttccttacaatattccagaatccagtccatgatgcacttcctgatttcctcactctccagaattatccaccggaccggatgctcattcttggcgctgggcgcattctccgccgcatccagcgcagcccgcaggatatccccgggaacttttttctttaaaaacctgcggtaggaacggcgctggtatatcagctgttttaccgttgtactgcagtcctccggcagaggctgggtcttttccaccacagcgggccgggaatcataagttattgcatccgccgggcaaatcgccgcgcaatgcatacaggcaatacactttttcccggtattttccgcctttccctcctggttcagccgcagtaccgtaaatgggcatacccgggtacactgcccgcagcccgtacattttgacgagtctataaaaatcatgcttcttccccatctttctgcttggtcccggcatcataatcccactgtccgggcagcctcagcttttccatataaggaaagcctttatcaaacgcttccgtttcctcttcggtcaggctctcaaatacctccgcttcaaaaaaccttcccggcatgctgcgcaggcctccgggcaccagctcaattcccataaacgcatcaaagtttttaccttccgcggtggtaatcccataatgatcacaggtctgaaaaccaaatttaggataataacccggttccccaaaaatcacaattcccggatatccttcctccctggcaagctgcattgtcgtattcaaaagcaggccgccaatccccatattctgcattgccggatcaacgcaaagcggcccgaagcaaagcacctcattactgctcccctccgcgccctcgatcctggctgcggaatacattatggttcccacaattttgccgtctgccacggcaaccctgctcagttccgggatatacgccttgtcagaacgcagccggtggacaagataatgctcattgcagcccggaaaatgcagattccaaaatgcttttttagtcatatattccgtctcccagtactcttccgggagctcctgtctgataataatttccatacactttctcttttcttttttatttccgcgatcaacgagccaaggtgatgcactcgtacatccctttgacggctgccgcgagagtcaaataccgccgttcacgacgtttcaaatttgatgccccattgcttggaggaatttgacttatgaggaggaattggaggcggcggctgccgtggaggccgcgacggctgcgcacatggctgcctgctgtgccacaatcatggaaatcgtcccgttgatcgcagcggtctccaggctgcctgcctttacatactctccctgtaccagcattcccgtatacatcagccgctgttttctcccgatgctccaattgcccagtcccttctgctttgccagaaaatcatccgtatccgtcatttccgtcacgatttccatcaaatcactttccgacactgccagcacaccaagcgtcggcagctcataatccgttccgtatttatatccccgttccttcagccggtcatagagcagcagcgtccggctgcatttttcttccgcccttccgtctcccagcgcaagaacatgactcaacgactgaaccgcatttcctgaaaaaaactgcggcctcaaaatctcatagcacctctgcgcttccgatagcaatgtactgtcatccctctccgacagtgaaagcagcgcggcaaaggagctgtcctccgaggaggtaagcagcggatgctctgatttcatctccttatataacgctcgggttcgttttacaatacgttcatagtcaaaaggctcggccatctgcgcaattaccatcgccgtcagaggcagataagcagaaccgaaaaactcctcctttagcatcccatataccttcagcgcattcgaaatcgtactttccggattccctgataccgccatcagggatgcgattggcagtctggcagtgcttcggaaattggaaaacatgcccgtatgctgcctgagcagctctgtacatgccttcagctgcccgccatccgcctccttgccgttcatagtgaaaatcgccgcgcaaagaggatacatataggtgctttcccagctgaattccttcctgattacttctttattttttatgaattgtctgcatctgttttctgtactttccttcatttcctctcctttatgcacgccggagcatatgcatgccaggcatgcataaaaatgccatgcctgcagaaaaatgccgccgggcggttactgtttttcataaataagttctgtcatcccgccataccgctctgtccctgtcagcttcagcttcctttgccggcctccgcctccaaataaacggataccatcacccagcagcacaggcagcacggtaatcctgtactgatctaccaggtccgcttccacgaactgcttcaccaaatcagcgcctccgcagagccagatatccttccctttctgttctctcagccgtcggacgagctcttcaggtcctttatctgtaaaatgtatttcctcctcatcctgctcactgcgatgtgtgaatacatatgtctgcattcccgcatatgcccagttatccggcgaaagctccgtccttatctgatgataggtggtatatcccatcaggacggtatccactgtctgaacaaaatccggatagctgctatcctccaggctccccgtatcatcctcctccatccagcccacaccgccgtttttgtccgcgatatatccgtccagactcattccaagatacaaaactacttttctcatgctatattccttttccgttataaattctctttctacccggctgttcctgctgccagatcatccaaactgcttattttgcgtaaaaacgttcagcgtatagcaacgtcagcattgacactccgcaatggataacgttgcttttcagccaatcaatcgctttcataattatttttattgccccaaactaaaataacgccttatttgttatcttctgaccgctggaacagggatatactatacccgcctgcacttaggcagtaggttagagctttcgtactgcaacaatttcatcaccgcacatttctccattttcgataaagcccatagcgctatataacgttttcgctgcgatattctccggctcataggaaagccaaacgctgtccgctgcgccgcagggatacgttttcagatagttcaatgccacatgcatggcttttttgcccaaaccctgtcgctgatacatcttgtctatcataaagcgccaaaggcaataattactggcggcaatcattggctcatcctcatcacctactgttccatagccaaacataataaaacccaccaaaatatcatcatcatatataccgaaaggcaatgcagttcccccggctgtaatagtgacataagcttcaagtatgctttctgtattagtagcaacaaagcccttctgttcatcaaaaacgctcagtttcactatcttccaaatattctcagaatctacttttcgcaattccataatatatactccttgcaaatttccatttgtcgttatgcggcttatttgccgaaggcgcatgaacgccttaccaattgttgcattctatgatttcaatacgattctgtcgaatataaaaatatcttttcaaaacttctcgcaagctattattttatttgggcaccaatcgggcaccattttactgtcttgttcacatgtctatattgcggaaaatcctgtaatcatgcgcaattccggtataattgacagctaaaacatactgaaaacatcactgttttttatcggcctttttcccataacaaatcacaagcgcaatcacattaaataatatcgtccccagaagaagattcagagcccctgacactaccgcctccgaggtatcagaaagtgctgaccagtccttaattttgaccagatgatcactgtagcatatctgaaaaaacagggacaaggcacaggcacacatactcgctccatataaaaccggctggtttctgtttcccgtctttttatatcggacaataataattaccggtattacaagcgctgtcaggcccagaagcaggcttcccacgtttaaccagctatacatacacattcctcctctttttcagcagctatcattatcatgatactgtttcttactgtcagactccccgtcttttaagatccatatcctcatctgccctggctgccttatgcgcctcttccaaatcaatgccgtagcagtcggcaatccggataagctgtcccagaatatctgcaagttcatttccgatattttctttcagattctccggctttttcccctgataggaataatagttttcctgcagcataatacatttggacaaatcgcccatctgtttggtcaattctatcatagcgccgtttattccccatggctttccctcaaccttttcaaatctgtggtaaatatccctgtaaagctgaattgcctcctgaaatgtcattcccataattttcccctttcacattcacttttttatttatatattattgtaaatatgctccttcaattactcctgctttttcttagcaggcttcttattcagcttcaggacaattcccttttcctgggcaattgcctgaaaacatccgaccgctgccgctgccttttccttcagtgttatctcctgtaccgtttctttcgccgtttcctgctttcctccccctgacgtttcacgtacaatctgctccatcgcattcctgagatcctgcagttccaacaggtacactgccagcatgtaaaaggttttcctgcgtccatcgttatagttctccagcagctcctgcaaaattgccgccttttcttccagttccgcctgataggcttccatcccaccgctttttgcccgttccatatccctgcgcatatttctgtgaggcagaaaggaatcatactccatcacactgtcatatttttcacagggatactcaccgcactgaaaacaatattccggacagccgtgttccctgccgcagcggaatatggcgcaggactggtttccctctccgccgccgcagccggggcaatacttattcaggtgcatggggcacagcgcgcagtttaatccgcagagggaaaacaacgggtactctctctgataatttttcatcttttttctcctggtaaaaatctgcgcttccggttacaaatcgttcctgtccctttccattgaatcctgaacagaaaagccttcgggatatcttttcttcagcttcttgatatttccctgcaggacctcttcaaggctgacatccaaagcggtggcggtttccgccagataccatgcaatatcccccagttcctttattaagtgctcccggtccagttcatgtccctgcgccagatgctttttcacaatatcaatcgcttcccctgcttcaccgcacagtcccattacgccattaatgagtatatcctttttctcaagagagggattcaatgtggtcattgcaagcctctgatattcattcggtgtcattttattctccccttcccagctctgtcggcatgaagtatttcttttccttcccaccaatcgtctgaatcaactttattcaaagtactttctttttccactccattaaatattcctgttcgccggtctctatatcagtctgttcccctgctatatgaaatccttccttcttataaaaccgcacggcacgttcatttttaagatatacatgcagggaaaggctgtcgcgattctgcttggcgcactgaagcaaatgcttgccgataccgcgtccccgattattttccccgacaaaaatccctgcgatataatcctcctgcagccccagaaaaccaaggattccatcttcgcagtcaaaaacataaatctccgcttcgggcatcatttttctgacttcgctgtaatgtgatttccaatatgttttctctataaaaccatgtgcctgtatgttggactgcagccacagctgcataatctgttccaaatcttcatttctgaactttctaatcatattctcctcttcccttttgcttccccgccggaatcagagccaggcggttaaagcacaagagcctccaaatccgctttttcataacggttatgtcccggcatgctctttttataattccagcacttaatggcttctttcagcgtttttccctgattttcagcaaaaaaatcacgaatataggtattatattcaaactggctgtcgatatttgtcccgcccttcttcttttcctcccggatttgataataggcgtcaactgcctggccgtaggtctttcccgtattcgctttcagccatttctggaaagcaacattaaaagaaaagccttttcctattttttcctcaaaaaaagctctatgcttctgggagcagacaaaatcaggctcaatcggagtatcatcggtaataaatccaaccccgctttttttcctggcaactggtttatccgcaataatctctccgccatctaaataactggcaatacgctccgtcagctccttttttccgcctgaaacgggaagcccctccgccctgcaaaacgccgccagttcttccttcaaataataatagctgcgaaatattttactgtccaaatctttttgtaaatgaggcctgtcactcaaaatgctttctcctgttgttttctctcattcatatttttttgtcattcatagatttcttctattcataatttcctgttatttatagtttcccgccattcacaaattcctcaggaaggatcatctcatccttcatcgggacaaagccgaattttgtatataaaggccttcccattgaggtggcttccagtgaaatatgctctactcctcttgtcagcgcctctttcacaagcaaatcaagaaccgctgaggctatcccgcggcgtctgtaatccgggtgcgtatacatattcataatgtatgctttgttgcccgacggattgtgaaaggtgggcatcacccgataaaaactgatgcctccggccccgacaaacagctcagcgtcaaaaaccagataggccgcatggctgccgtccctgagggctttttcatagtaatccctggattctttttcaacggcagacatatccacggaaagttccagcccattagctgcccgcagtacctggattctcgttgctgtcagcattgcgatatctttttctgcggcctttataaaatcgaattccgactgtatatccattgtacctcccacgtaggcaattccaacctataaataatctgccaaatacgcatcgttccatagctgtacctctatatagcttccgggattatgaaaaagaccaggcaggtcaaaaataaattcgccaacgcttttttccgaatcattaatcatacgaaaaaactgttttttattccagacagtcccttccgtcattcccatactcctcaaatgcatactgtccctgggcgtaaaactgacctccatatcatctatatggctaagcggaatactgattttatcctgatttccaaaaaagctctgaaaaccgctgtgctcccctaatacaaaatatatgggatgcatcgttttgggctttccgcctccttcaaggaaacggttatacagccatttttcagttgccgctctcttctggtaataccgttcaaaataatcgccgtaccgatcattccttgaagttgtagcagctgaaagtctctccgccaaaagaaacgcttctttttcaggaagacgcattatattccgtaacggcagtccaccactttccctataattggtaatcactaacccatccaccgttaaatctgccattgctttcttgcacagataatctgtttttaaaagagcaaaccatataatatctgttttttcaccatcattgccgaaagactgggcctgccgcagctgtccttccaattgatacccacatttcagcatcactgcgacagcttttttatttttaccattgcagtgagcctcaaccctgtttatatcagtcttttcaaacagataatccgtcagggttttgagcgcctcctgcatatatttcttattctgccagacttcatccagtgcaaactgtaatgttattttatttatttccggctcatattgcgctttaaaatggccaattatttttctgccttcttttaataagattgtccatataaatgtttccagaccgctacacttttcatccggcctgagaattagcctgcatgatgtaatttcttctgccccgctaagattcatatatttccctcgcatctgcaggcagttttctcacatgctccagatatgccctgcaattatccgcctccgccgcatcaaaatggaagttcattttctcagccagttcttcctctatctgcctgaatagatcgcacataataaaaactgcatcccaaacagcctctgtttctgcctgggaataagttaacagataccttttataggtttcctcctgcaaataccgtttcatatattttgccgactttcccacgctgacggaaaaattgttatccctgccgattttccattccagaattctggtaagcatcggccggatatacagatttatcatatccattacatagggaagctcctcccgccaaagtcccttcgccacgttatccagacaccaccagaactcattacaggtaaaataaaactgctcttccgtcggctttttcacccagtaaatctcatccgaggccggctttgcttccggcaggataccatccttatctaccagtatccgatagatttcaaggctgctctgtaccgccttcatggtactgacatgcagatccagcctgtttccatccgtaaactgcatcagccagccataacagttttccacatcagaactgaaatatatgctatcttccggatattgcataaacaaccgttccccgaatctgtcaatccattgcctgtcctcacggaaggatttagtctcgtttacaacatataccacatcgtaatcctgaaaaatatccttgggaacgttagggttaacgcgggatccttccaaatatgccgccctgatacgcggatcctcttctgcagtttttataatcaaatcaagcatttctttttctgaacgcatttttcctcctcaccttttccacattaaatttatactgttttggaatattaaattatatgatatttacataataattttccggctgctctctttcctctccccgaaaaaacgccgccatttcactctcacacagtgctgccgatttattaatatattcttccatcagctccaatttataaatttcaagcgcctccaccttagcttccgatgcacattgaatatcatctttcagggcactaagaaaattttcaagaagctctccctttacttcattaatttcttcaatcgatatgttgcgtatgttataacgcaggttgtatttttttcccagcagataattcagcctctgataatcccgatatcctgccttataacggtctttttttatttccggcggataatttctgatatacttgtcggcaatggaacaaaaccatatactgtccataatcagatgacagtaataaccaaggtataagctgtctttttccatctgctccgcatacctgtctctaaataaaagccagttaatcccttttttattttctttctccagctccacccaaaaatgcgccgtattgtaacttccatcctcatgccccgacaggtcaggcagcaaagcgccgatacaaaaacggttcttatcctttatttcctgcctttcagcaagttctgatgctattagataatgtaaaagccgtgatgccatttttcctccccggccagtctgccatacacatcattcctcctccggaaccgcctccagcaaaaaaatcaccggacgcacaccatcagtgcagcattctattgtcttattttcatgcttataccagtattccttcccagtttccctgggcgcacgatcgattgccctgcgggaaatagctgcgtataagtccacccatgcccaggggcagaagccttccggcatgactgcctcctctccggatttataaagaaatgaatccccttccttcagaatcggacacggaccaaccgcccttccttcgctcagatattcatctgcaatatcctcataaaattctgtctttaatactttaatacgcacatccatccctttatccccctgcttttcctttttccctgcttccaccgtatttctctgccattacagtcagaatgctccggttaccataaaaactatgcctaatacaagaaatatccctccgattcccataaaaattccgcatagaagcttcatcatttttgtatcacgttcacaccagaatttttccggtttttccggatcataatgcaattccgtttcttctcctgtctgataccggcaggggctgcttccaaaagtcgataccacccgctgcattctgcctccggcatagtattcaaatacgggataataatatgtgctaccaccactgtctcttctgcattccacatccactacccgcgccgtggtaaccatcgaggcggtctttcgcctcctgccaaacactttcaccaaaaaaatcccaatcagcaggaacagtaaccccattcccgcaaaaatcaatgctccaacctgtatttccatcatatatgtatcctctgccctcaatattcagcctcagaatagaaaaggccgttcattactgtactcccggtacactgcacacccgtatcgcgggatttttcattttcaattcagctaccaacgccgttttatccttcaccgatatcaccatttcctgtcttttccccatgataaaaagacgatccaaagaagcggcactggaagaaatcgggcaataggaacctttgatttccacaatgtcagcaatccgcatggaatcctttccaaaaccgaaaaacagcttcaggttttcttcctcaattaccacatagttgcgcacaacgattggtataaaaataatatcgcacagagccagcgaaaataataatatgggcacattatcagggtcaaaaagcagttcgtatatacataccgcatttaccgcaatgataatcagccagaaccatgcggctacttttcctttaaatttcatgcttcctccattatcttgccatatatcgcagttcatcctttttctgtccttactgcagctgtccataaaaaagttctccgcggtatgatgacgcattgatgtctgttgcacaaagatttcagaatactcagaaaaaagtgcgtaacagaacagtatccgctatttattcagtatatcaaatatttcctggcaatactatgaagtttttcttatattaaggggtgaaatagaatttatgtagagaacaggccagttatctgcctgtcctgttttttgcttcatgcatgggatacccgtttccctgggcatctgttgaaggcgtattttcatggctgtttttatcatggcttgggccgtgccccaccacgcctgcctcataaacgccgtccggtatggttgaaatacgtttatcgtcctttgcttttttcatggagacctcctgacttttttctgctgttattgtccccgttttctataaaaaaataagcatctgacgatgtttatcactgaaaatctcatctgtggtggagttgagctttattttatattttagtatagaattcttaatttctgcagtagatatctttaatgtttcataactattcaaaatctttgaaaagtgggaatgaaaaaaccgggaatatcccagaaagctccatagttgcatgtagattgaaaacgcagatacgatggcttttcaggataatcccgggccggctgaatcgataaaaagtcaatcaagatggagtttataaaattttgccgggaaggtttcactcccgtcaaaacggctgtattctccataatggtcaaaatacataccgcatttttccatgactcttcctgacgccgggtttgccaccgcatgatttgcgccgaagtcatgtatatcaaattcttggtatgcaaagtcaatcatagcttttgccgcctccgtggcatagccctggttccagcagtcagaacagaggttgtagccaatttcccactgtgtattgtcttccgccggtcctatgccgccgctgccgattaaccggttattttctttgcacacaaagccaaattcatattgtttttcgtttttttccacggtttccagccatctgcgtacgtcttctgttttcgtataaagggcgtaaggcatgaaacggtttaccagcgggtccgagcaccagataaaaacttcttccgcatctgcggctgtgagcggcctgaggatgagtctgggtgtttgcaggatgtactgttgcataatcgggagcctttcagtggtgtcttattgaagatggttttctgatattattatgtatgagattattgtttatgagattattctgcctgtaacagtttttccagttcggtattcagcttctgtttcatttcctgtagttcgctgtctgaagggaggtatttgtcggcatacatttcttctttgggaagcttccatacagggccgggaacaggagtatccccttttctcctcggaaaaaagtgccagtgcatatggatattgtctccctgtcccagcagttcatagttcattttttcaggctggaacgcgcggaaggcagcttcagcagccagcgacatttcgtggagaaagaggtcacggaagggctgttccagctgatgcagttctgtggcgtgggttttgcagagaaagagtgtgtagcctttaaaacgttggtagtctcccaggacaacataaccggtctggagttcttttacaaaatatttgttgtttcctttcagagttttttgaattcgatcgcatactccgcacatggggttctcctttgttgatgggatttttttagtgattttggggatggattggaatgttagggaattaatgtcctggggccgtcttgtttgtctgatatgggttaactcttttccatttgttttattctacgattacatggcaattctgtcaaatctatagtttgtaaaatctttagtttataaatagttggtttgtaatgttgggcaggggtgagaatgctgcgcattctcacccctgtatgggcggacagatggcgaaggggaagggtgatggaaggaggacgcctgacgcctgcgagtaatccctgcgggatttctcgcgcttcgctacgcgaagctttgtaaaaagccataaggccccgttgctctgcaagcaggcatcggggccttatggctttttacggcgtcgggctgggtatcggggatgtgagggttattgggtgttcatcttcaggagcttcgccgcctggtcggctgcgatcaaactatccaacaattcatcaatatccccattcataatatcatcaatcttataaagcgtcagctttattctatggtccgtaacccttccctgggggaagttataggtccttattttttctgatctgtcccccgtaccaatctggctccttctcagttccgcttctgcatcgtgtgccttctgctgttcaatgtcatacagcttggcacggagcagtgcgaatgcttttgctttgttctgaagctgtgatttctctgtctggctgtatacaacgattcctgtggggtagtgggtcagtcgtacggcggagtctgtggtgttgacgcactggccgccgtttccggaggcgcgcattacgtcgattcgtatgtctttatcgtcaatgacaacgtccacatcttctacttcgggcattacagctacggttatagtggaggtgtggatgcggccgccggattcggtttccgggacgcgctgtacgcggtgtacaccgctttcgtatttgagtttggagtaggctccttttccgttgatcatgaagctgacttccttcatgccgccgattccgatttcgtcaactcctacggtttccaccttccaacggttccgttccgcgtattttacgtaaaggcggtacatttcggcggcaaaaagcgctgcctcatctccgccggcgccggcgcggatttctacaataacgtttttatcatcattggggtctttggggagcagaaggatcttcagttcctgttccagctcctgtatgcgtttttttgcttcgctgtgttcttctttgagcagttcgcgcatttcttcatcggattcggattccagcataaagaggctgtcctccgcatcctgttttgctttcttatattctctgtagctttccacaataggagtcaaatcactttgttccttcatcaaagccctgaaccggtcctggttggccgttacggtaggctcgttcagttcgttcatgatttcctcatatcgccgaagcaggtcttccagcctgtcaaacatttttataccattccttcctgataaacagccgcatatcgggcggcttttcttatacatttactgtggcagggtgtccgttccataccaaaatccggataccacccggtccagtccggcaaaatcctttgtcacctgtacctcatgaaacccggcctcttccatcattttttttacggcagctccctgatcaaagccgatctcaaaataaagaccgccgccccgcatcagatgctcagtaccgtcctcaagtatccttctgtaaaaaataagtccgtcttctttcccgtccagtgccgtcagcggttcatgcagcctgacctcttccatcagtccatcaatgacggcagttggaatgtaaggcggattggatacgataaaatcatattttccatcaatattttcaaaaagattcccttccacaaaccgggcctgtattcccagccggtccgcattttcccgggcaacggcaagcgcttccttggaaatatcggccccggtcccctggcagtcattggaataatggagcaggctcagtaaaatacagcctgatccggtacacatgtcaagtattctgctgccgtccgtcagctgccgtaatacttcttccaccaggatttccgtatcctgtctgggaatgagcacatgctcgtttaccagaaaggtaagccccataaattcctgttcgccggtaatgtgctggagagggatgtgccgggctcgcctggatatccagtcgttataagcgctctcctcttcatgggacacctgtctgtccccgtgaaccagcagcgtattcctgtccgtatggcatattgtttccaggagcagtctggcatccagatcagcttcttcaattccggccgccttcaggctctgccggccccattcatagcattccctgtagttcattgcagcgccggctccccggttttggtttctttcccatcagaagcgtcacccgccccgtcctcatcctcatcgaaatcctccggctgatcatcctccatcagccatgactcatccacttcatacccgaattcctccttcagatatgccttccagtcaaaaaccgcatttacagaggcaatcgcaacttcaatcatactttcatccggttctctggtggtcagtttctgaagccacattccgggttttgaaatcagattgatgattacattgtcatttcttcccgcaaggcggattacttcataggaaatcccggcaattacaggaatcagaagaatcctgaccacaagcctgagcgcagggttctccacccggatgaacatgaaaaggataatgcttatcagcatgacaaacaaaagaaaacttgttccgcaccttttatggagcctggagcttctcattgcatccttgacagtaagaggacgccccttttccaggcagttaatgcatttgtgctccgctccatggtactggtaaacccttctgatatccttcatggaagcaataatggccacatatgccaggaaaatggcaagacgcaccacgccttccagaatggcgagaagagaagcattcctgacataggaatgaaacagcaggctgattccatagggaagtgcgataaaaatcgccaccgccagaacaatagagaaggctaccgtaaatcccatgaataccttttccgcatttcctttggttactttattcagcagcttgtccgttttggtctcttccgcttcatcatcttcgtaaaagctggcggaataggtcagagtctgcattcccagcacaagggaatctataaaattaaaaacccctctgacaaacggcagctttgtaagcttgctgccggccagggctccggcatatttttctttcttgacttcgatgtttccgtccggctttctgactgctacggcgtattcatctttatttttcatcatgacgccttccagaacggcctggccgccgatgccggaatagtgtccgcagttctttttactcatattaattcctcccttacgggttgtgttggatttggtgcgggacagtaactgtgagggatactgaacagttacgcggtatatatatgaaaaagaaggttgagattaaataacctcaaccttttttcgcagctcttatttgttttccacgccgtactttctgttgaacttgtcaatacgtccacgagcctgagcagccttctgctggcctgtgtagaatgaatggcacttggagcatacttccacgtgaagttccggtttggtagaacctgttacgaatgtgtttccgcagttgcaggttactgttgcctggtaatatccaggatggattccttctttcatgatttcacctcttctatttattgtgttcccttattgttatttcgttctcatccacttgcctttcggccgccggatacagattaacctgtaaacagctttttaattgtagcatagcttttctgtcaatgcaagtaaaaataagcaaaaagcagcaaaaaaacagcaatatttctgcctgacagtaattccggatatcagataaacttcatttttttcacaagatttacaaaatcggcattatttcttgtacgtgcgaacatatcaagaatcttatccacagcttcttccggcttcaggctgttaagcgctttgcgcagaataccgatggcttccagttcttccggggtaagcagcagatcttctcttctggtgcctgattttggaatatcgatggcaggaaatactcttctttcggaaagctttctgtccagcacgatttccatattgccggttcccttgaattcctcataaataacgtcgtccattttacttccggtatccacaagcgccgtagccagtatggtcaggcttccgcccccgcgcatgttcctggccgcgccgaagaaccgtttcggcatatgcagggctgccggatcaagaccgccggaaagagttcttccgctgggcgggattacaaggttataggctctggtcagacgggtgatgctgtccagaaggatcatgacatctttcttatgctctaccagacgcttcgcccgttcgattaccatttcggagactcttttgtgatgctcaggcagctcatcaaaggtggaataaataacctccacattcggtccttcaattgcttccctgaaatccgtaacttcctcaggccgttcatcaatcagaaggatgatcaggtgcatgtccggattatttacttttacggactgcgcaacctgcttgagcagcgttgtcttacctgctttaggcggagatacgatcatacctctctgcccttttcccacagggctcatcagatccatgatcctcatggccgttgaagagcgtgacagctccaggcggactctttcctccgggaaaataggcgtcatgtcctcaaaattacatcttctcgccgccacatccggagaatatccattgatggatttcacataaagaagcgcgctgaatttctcattctgggttttgattcttgtattgccttctacgatatcgcccgtcttcagattaaatctgcgaatctggctgggcgccacataaacatcgttttctccgggaagataattggcgcagcggataaatccgtagccgtccggcattacttccagaataccatgcgccgcaactccgctgtccagctctgatgggaacttgtcgtcatcatttacattctgaaccggcatcggattatcctgctggctgctttccgcgcgttccgtattatagcttctgttctggggaacgctgcgttctccgttataggtgcgttcaccctgctgtgatcccgcggtattctgacgattgtcgttattattcgtaataatggttcttgtactccgctgctcctggtttccgtagttcctgcggctgccattctcgttctgtgtattccggcgcatcggtttcctgtccgtcccgcgctccgccggtctgttctgggaagcagtctgggactgattcgcctgctgtgattgtgaggcgctctgcggctgcgttaccgcctggggctgtgccgcgctctgtgcctgggttgcgttctgcacttgaggtgccgcctgctgtacattctgcgcccttgcctgtcctgccgtttccgcaggcgctgcctcttcttctttttccgctggcgatttcacttcagaaggcttctctgccgtccttttctccggggcagtcttttccaaaggcttttcagacacactcctgctccggctctttttcggcgcagccgcagccttgtctgcagcgtctcccttttcttccgtcctgaccggcgtgccgggccttccttccgcttcctcatcaagggccaccattgcctcaataatgtccgctttcttcattccggaagtgcccttgattcctcttgacttggcaatttccttaagatctgccaatgccagggactgatacttttctctcatgctcatgaatttcctccgtgcttatagtacaaaatgtttcaaaattaaatacgatgaatctggttcaatacaacccgctaataaacaggatgacttcctgctgattcttctgtctgttattcatttctttcttttattgggaaataaattaatgacacctggctgacctgccgcttatcgtaggtatgaaaagccagctctccacgtctgttcaatggcgccatccggcagccggacatgtgacgtcaacaagatatgtattgggatacgatactttaaaaagtaaactttatgtgtccacattatacaccacattcaaaaaaataggaagcttttttttcaaaaagcttccaggatgcgtattttacttgatattttatcaattttgaataagtttaaaacgtatataagataacgtttaatattattctccgtcaatgccagtgcgtgtttccgctgccgtttttcccatccagaaagtcctgcatctgggaaatttcctgcccctgcagctcaattacactatttgcataatccgttaccgaatcattgtctgaatattttatgatggtctcagccatatccacggccatctgatggtgcatcaccatgccttctgcaaaagccgtatccaaatcctgtgtatcggaggagccatgacctgaatgatgtccttccatcatttcatcatattccttaagataggcttcctctttcgtcccatcggtctggtaaccgctttttatatcttccatcatattcttcatctgctcgatttccgaagtctgggccatgataatatcctctgccagtttcctgaaatgagcatcctcaggagcatacttcagatactcctccgacatttctatggcggattcatgatggggaatcatgccggtcagaaaggccagtgaggaacttcctgtcttttccttaagctccatatccttcatcatctgatccatgattttatcctgcgctttcagataggagtccacccctgaactgcttttttggcagccgggcagaataaacattgcggtcaatatgattaaaaataccttgcaggttttgtttttcatttctgtctccataatagtggttgattgattgccgcttgcggcctctgtttctttcaaaccatagtatctgcaaaatattgaaatatatttaccgcaccggttctttccttataaaaagagccgtaatttatcgcttttctcccttcccatccgacagcagccgcctcattcatccattttcatccccaaggcggcacatgccaaacatgccgccccgtttcaccgccgcctacttcagggaaaataccattctcaccggatcatgatccgcatacaaataacctgtatggatattttcatattccttcagttcaatattatccgatataataaatccatccagcgtcaccgtataagtcacaccttcctcataaggcatatccgcattccgggcgctgtccggaagagccgcctttcccgcttctcccagaaaatccatgctgaaggaaaagccctccggcaaatcggatctggggaacggatacgcccaggacgcacgatcctcctcagtatcctcggatgccttcaaatcgtgattgaaatccccgccgcatatcacataattccccttctcatattccgcctgcatgtccccgcacagcttattcacctgtgcctcccggatagcatcgctgttgccgtaagcagacatatgcagggaaaaaataaccagctcttttccattgtccgcagggatcctgctgatggaatagcatctgtccagatcaaggaacttgctgaaggaggtggatatggggaaactcttccttacagccgatgcaattggatattttgaataaaaagcgattcccgccaggctttttccatgaggctcccagggcgggaccatcagaaacgctgaatcataattgatggcaaaatccgagtaatatccgctgaaatacttatccagcagctcgtattcatccacatggtaactccttgtggctttaagatccacctcttcaaaaatcatgaagtccggatcatagcccgccgccagctcaccggcgcccgaaaccgtggcaagcacgctttccttactggctgcaactgaggatttccctccgtccataaaaaaactgtagtccggcgtgtaagcgccaaagccgatattgtaggtgataatttcataatctgtaccaacggaaaccgtaccggttatatccgcattctccggcgtcctcacatccagcgtcaggtcatccggaagcctgtgatagcttatcatcacgtacaggacataaccgataatcaccagaagcagcgcagccagaatccccagcagtacacgcagccagatccgtttctttttcccctgttttcccattctatacctcctgtctctttctgtcttttatcttactccatcctgacggaaaacacaatcttccaggttcgctattgcgaatcgaaaccaaatattatatgatacttctgtagcgttaccctgccggaaaaacaaatgggaggaaaaatcatgacaaccaacgaaaaagcactggaattacataaagaatggaatggtaaaatagaaaccgtttccaaaacacccgttaaatcaagagaagcgctgtcactcgcctatacccccggcgtggcggagccatgcaaggtgatagccaatgataaggaagccgcttatacctataccatcaaggccaacaccattgccgtggtatccgacggctccgcggtcctgggccttgggaacatcggcccctatgccgctatgcccgtcatggaagggaaggccgtcctttttaaagaattcggcggcgtcaatgccgttcccatctgccttgacacacaggacacggaggaaatcatcaaggcggtaacctggatggctcccggcttcggaggaatcaacctggaagatatcagcgctccccgctgctttgaaattgaggaacggctgaaagccaccctggatattcctgttttccatgacgatcagcacggaacagctatcgtggttctcgcaggaatcatcaacgccctgaaggttaccggaaagaaaaaggaagactgccgcatcgtggtaaacggcgcaggcagcgcaggaattgccatcaccaggctgcttctgacctatggcttccccaatattatcatgtgcgataaatccggcatcctttccagggatacgaaggatttgaactggatgcaggaaaaaatgatggaggtcaccaatcttcagggagaaaacggcacgctggccgacgccatgaaaggcgctgacatctttatcggtgtttctgctcccggaatcgtaaccgcggaaatggtttcttccatgaacaaggatgccatcctttttgccatggccaatccggttcccgaaatcatgcctgatattgcaaaagccgcgggcgcaaaagtcgtaggcacaggccggagcgactttcccaatcaggttaacaacgtggtggccttccccggaattttcaagggcgcgctggaaggccgggccacacagattacggaagaaatgaagctggccgccgcgctcgccatcgcatcccttgtgcctgacgaggaactgaacgaagacaatatcatgcctgaagcctttaatccgaaggttgcggaagtggtagccgaagctgtaaaatcacacatccggaaataggactatggattatcatggcaagccctattattccctggacgcctggtgtaaggacacctatggtgaaaaattatataaaatagcgctggatgcaggtttaacctgccccaaccgggatggaacgctggatacccggggctgtattttctgcagcgcaggcggcagcggtgattttactcccggaagcgccctttccatccctgaacagctgacagccggcaaacagcttcttcgggccaaaaagacaggcagccgctatatcgcttattttcaggcttatactaatacctacggacctgtatcctatctggattccatttacaggcaggcgctttccgaaccggatattgccggcatctctatcgcaacaaggccggattgccttgaaaatgaagtcatggcgctgctggaaggcctgaaaagtgattatccggacaagttcatctggatcgaactgggactgcagaccatccatgaacaaaccgcacggtatatccgcagaggctatgcgctttcctgtttcacccatgcctgtgaccgactgcacgccgccaggattccggttatcgtgcacgtaatcctgggtcttcccggagaaacaacggaaatggtcctggaaaccatccgtttccttaatgggtgcgggattttcggaatcaagctgcagcttctgcatatacttgacaatactgacctggccggtgagtaccgcgcaggtaaggtgcaggtgctcaccctggattcctaccttacccttttaataacatgcattgccgccctttcgcccgatatcgtcatccaccgggtaaccggcgacggcccgaaaagccttttgatagctccggactggagccgtaacaaacgtaacgtattgaatacgcttcatcagcgcatgaagctctcctcaatcagacaaggacaatgctatgaatcaggaacctttgactctttacaaattaattgtactgtacatgctggacagggtcacatttcccctgaccacagcgcagatcagtgaattcgtcctggataaggaatacaccaattttctgaccctgcagacagccatttccgaactgatggaaaccggtctggctgaatcccggacaatactgaacaggacacagctgcagatcaccgacgaagggcgcgataccctacactattttgaaaaccggatcagcgatgccatcaaaagcgacattatcgattattttaaaaatcataagctggagctgcgcaacgaatcctctatccaggggaatttttacaagctggtaaacggggaatttgaagcccagctggtggcaaaggacaaggacgtggatctggtgaacatccgtatttccgtccctacccaggagctggcagcttccatctgcgccaactggcagaagaaaaacaaggaaatttaccaatacctgacggaacagttattttaattataaaaaccctggcatacacacaacaatactgtgtatatgtcagggttttttactatcctcttttcggcacatccccgccgttatatttttcttcctcttccggcagcgccgcttcttttttaatgcgcttcatatgctcttttattttcacttcataaccgtttcccgaaggtttgtagaattctcttccgcttagttcataaggcagatactgctgtctgacataattattcggataattatgagcatatttataatcaagtccgtgtcccaattttgccgctcctttataatgggcatcctgcaggtgcgggggcaccggcagatttcctgtttcctggacacaacgcatggccgcgtcaatggcgcacaccgctgcgttgcttttaggcgcgcaggctacataagtcaccgcattcgccagaatgatctgggcctccggcatgcctacccgctccaccgccagcgatgcgctcacagccacctgaagcgcctggggatccgcatttcccacatcctccgaggcgcaaatcatgatacggcgcgcaatgaaggtgatactttccccggcataaagcatttttgccagataatagaccgcagcgtccggatccgacccccgcatgcttttgataaaggccgaaatcgtatcataatggttgtccccggtcttatcatatttcaccacacgcttctgaatgcattcgcccgccacctccagcgttacgtggatttttccgtccgcggcccgcggcgtggtcataatccccagctctatggcattcagcgcatgcctggcatcccctcccgccacatcggcaaggaaatccatggcgtcctcatctatctccgcgtcgtaggcgcccatccccttctgcctgtcatagacagcccgccgcagaagctcctttatatcctccctggacagaggctttaattcaaaaataatggaacgcgaaagcagagcgccgttcacctcaaaatacgggttctccgtggtcgcgccgatcagaattacggttccgtcctccacgaacggaagaagataatcctgctgccctttattaaaacgatggatttcatcgatgaacaggatcgtttttttcccatacatgcccatggtatccttcgccttggccacgacctcctccatatcctttttcccggcgacagttgcattaatctgggtgaactccgcacttgtggtattggcgatcacctttgccagcgtggttttccctgttccgggcgggccgtaaaaaatgatggagctgattttatccgcctggatcgcgcgatagagcagcttgtcctttccgataatatgctgctgccccaccacctcgtccagcgttgttggccgcagcctggccgccagcggggattccttctccatactgttttctctcatataatcaaataaatccattgtatttttctcctgatgccgtactttttttgcgtcggcttcctctattataacgtcccgcaaccgtgaaatcaatcagcgccggccagggattttaaaaaaagacaggcctcggcagcggttcaggcaggtctgcgcatttaccgcactgaccgcaagaaaatgattcaggaattccctccatgtgcagccgctgaaatactgccaaaggacacacgccgcataattttatccgctctccatatactaaaatccaaaaggaggaaatatcccatgaaagatgaagattacaatattcccgaagatcaggactacaccagcgccgtatccgcctatgactgcacgggtctgattcccgccggcaccgtccatgaaaaaacactggaagcctatcgtgaattatatcccttcggcgcgcccgaaatgagtgaaaaagaaatggaacagatgagagaaaaggataaaaaagaaaaccaggactgacagtttcataaccatgcctgacagcttcataacccggatttgcagtatcggaagaaataccaggctgcccctggggaaaagcaatgccgccgcaggcagctgccctgccgcttcaaacagcttcctttccatctccttacgatggaagcggtctgaggcggcgctgtttttcccatatcattcccgcaaagcttcagtcaaacaaaatctcgtcaaccgtcacgaattcatatccttccgctttcaggatatccacaacctgaagcgctgccgtcaccgtggaatcataggaatcatgcatcaggattatgctgttttccttcgttcccgcaagcacgctcctcacgattttatccacgtttgtggagcaccagtccagagggtccacatcccagagcacaggaaacatgttcagctccttttcatattttttatcccaggaaccgtagggcggacggataaaggaggtttcctttccggtcacctcctggataatatcgttggttgaaataatttcttttttaaaatcatctgaatttgccgcagtcagctgtacatgatggaaggtatggtttccaatgagatgaccgtcctcgctggctctttttacaatttcaggatagctctctacgttttcccccgtcacaaaaaaagtcaccttcacatctctttttttcaggccgtccaaaagctgcggcgtacataccggatgcgggccatcgtcaaaggtcagggccaccttgcccttatatggcgcttcatcctcatagccggcgtccgccagtgtatgggaggaccacgcttcctgccttgcggccccgtttttctctcttgcaaaataggacaaagccgccgtaaaaagtactatcgtcaggaacgctatccatctttttcccttcagcatgacactgacctctggtttccgctttctttcatactatatgcagcaggacggaaaattatcattccttcctggtaccgtgtgcaggttcgcgaagcgaatacgctgacctggcctgccgaacagcggtccttattacatcacgttctgcggcttcccgtccagatagcatgcaatattatcgaatacaataaccgccctcttataaagggcctcctttgtagcaaaagccacatgaggcgtggcaagcagcctgggcgctttcagaagcggatgctcctcgctgatgggaggctctgtttcaaatacatccactgccgctccggcaattcttccctcttccagggctgccgccagcgcctggctgtccaccaccggccctcttgccgtattgacaagaatcgcattgggcttcatcagacgaagctgcgcctcccctatcagcccctttgtctgttcggtcagcggtacatggagtgatacaatatcgcattcccgaaaaagagtatccatatccgtcatggtgacgccttctgtttctctggggctcctgttataaccgtaaacctcacatccaaatgccctggcaagctgcgcggtccttgtccctattgcgcccattccaatgatgccgaatttttttccttccagctcctgtcccacaagcccggtcttatcctttccctcacggacagcctgattgcactcaataatataccggtaaagattcagcaccatgccgaacacaagctccggcaccgccgtattggaatatccggcgcagttgctcaccaggattcctctttcccggcagtaatccatagccacatgatccacacccgtaaaagccacggaaatcatcttcaggttatcacagtgctccagcacctcttttttaaagggcagattggaaaaagcgagaatatccgcatccttcgcccgttctatcaacgtttccgtatccgtaacgcgggtatcataatatacgatttccacctttccttccagtttttcctctgccagcgcaagaagcttctccttttctacgccgagcggttcaataatcacaagtttcatcttttttatcctcctgtttttatggagtaaaatgcgcgtcctctgaaaaggaaatgattttactcctgattttagttttgcggagcaaaatacaggttccctgacgggcagtttttttactccattcatttaactgtcaacgcaaacgtatgtaactgtgaaaatcctgaacagtcacactcagacatatacaatgtctgataattccccgccggaaagcaccggttaaaaattcagccgttccagatatttttgctcaaagcccggcaattccgccagattcagcacctcggccctgcggcacatggcttccgctttttcccgcagggattcctccccgccataaaggcaggctcccaaaagcgaggtattccccaccgcagtcacccttcccgccagctgcggagggaataaaccgatccgggccgccttttccacatccaggaaataaccgaaaccgccggccagaaagactttgtcaatccgggaggcatccgtccccatagcttccatcagcagctccacacccgcgcataccgctgcttttgccatctgcagcccgcggatatcctgctgtgtgatacgcagctctcccttctgccagcccgtatcaaaaaaaggctctttaagcaggcctgtctcatcaatcacaccgccctccagcatttctgccagcaatgcaatcatatccgttcccggcacattaactcctgcgccgccttcaaaagccgggccggccgcggcagccgtacagatgagcctgtctcctctgccgattgccatttccccattcgtcccgagatcaataaacaatctgcattccccgtcttcacactctgcaaaaccgcaggccagaagccccgccgtaatatccgcgcccacaaaagccgatattcccggcaataaacggatctcctgtcccgaaacgccgtccttcccctgccttccgggaagacacatttcctgcaggcataccggagtaaaaggatatcttccaagcgtccgcgtatccagctccatcagcagatgctccatcgaagtatttcccgccagccagatactctccggcctcccgcccagttcaccgcaaagctgttccacaccctcttccaggacatctctcacagcctctgccagttctccggcctctcccctttccgccgcctgcaacctggaaatcacatcactcccccacctgcgctgcggattcatacagctgtattcccccaggatacgcagccttcctccccgcttcagctcccgcagggaatccgctgccacagcctgcatggccaccgttgtcgtccccaggtcaactgcgatcagatactctgcgctacggcccggcatccctccattcgccgcgctgcggcctttggcggcacctgcactgccgtcccttatcccgccgccatgagtcgtaaccgcctccaccgccctgctttccacgaactccacccgcatagtacaatccccctgtacccggtgcatacacgccagccggtatccttgtctcagctcctccgccgaaaaagcgatcctgtccgccgccacaggcagcggcgccctctgcccctcgaacaaaatccggcaccgcccgcacgtccccttcccattacagcacaccaaaggaaaaccatgcatcttcaaaagactgagaaatcctgctcccacaggcgcttcgatcacccgctcttccccgtcccgccttaccgttatcctcttatcagacaaactggtttctctcctcatcataaacataatctatcttcttcaatttttccacaagcccgtccttatccacgccgcactcctcgcacaacgcatccagactctcataaaaatccctgagcttcatattcacaaaactcaacagcatcaccggatcctcaggcatcaccataacactacctccataatcatccaaaaaatcagccgcaaccgcctaatcctttcacagccccaacatcccctgcaccatcacccgccccgcaaattcaccagcaggcgcctcccctattataggcaatccccgcccttctttcaagaaacctggcttattttcttttaattcttcttagcccagcctgctgccgccaaatctttttcccaaaacagtcaattccagctccgaacaattcctccaatacttattcctgctacaaggcgtgtgtcactctgccctgagctggttttgtccccggagacgtcagcggcggtgatgcagtttcccccccggaattcatgtatatattttgttcatattatgaaatggacttgacatagcttcttttttgatgctattctgaagataagttaaaggggagtagtatccatgtacaatcaacataccctgattcaggccgtccgcattatgggaaacgcagatttatagtaccatatgccgggacaggcaggctgaatcatggttgtacactttctgtgaagaaagaacgagacttttggcgtacgccgaaggtctctttttttatggttttacaggaatttccccgggcggcgtttttgctttaccattactgtaagagtctgacgcttcccgtaaaatgtacatgccgctgcagccctgcaacattttaccaccacaaagaaaggatgaaaaagtatggaattcatttatgaaggattactgtccatcaccccccagcaggtaattatgtatcttgtcggcctcctgctcatttatctcgcaatcaaaaaggagtacgagcctgcactgcttctgcccatgggcttcggcgccattctcgtcaatcttccgctgtccggcgtcatcaaccagaccatgtccggcatcggagaggttaacggtatcattgaatggctgttcaacgtagggattgaggcctccgaagcgctcccgattctgctgtttatcggtatcggagccatgattgacttcggtccccttctctcccagcccgttatgttccttttcggcgctgccgcccagtttggtattttctttgccatctgcgccgccgcactgatgggctttgatttgaaggatgccgcatccatcggaatcatcggcgctgccgacggccccacctccattctggtttcccaggttctgggttccaggtatgtcggcccaattgccgtcgccgcttattcttacatggcgctggttcccattgtacagccctttgccatccgtctggtcaccacgaaaaaggaaagacggatccgcatgcccgccaaaccggccagaccggttacaaagaccaccaggatccttttcccgataattgttacattcctggtaggactgatttcccccgcctccgtatctttggtcggtttcctgatgttcggcaacctgcttcgtgaatgcggcgtcctgggaaatctttccgataccgcccagacctcccttgccaacctgattaccctgcttctgggaatcaccatttccttcagcatgagagcggatgccttcgtacgccttgacaccctgctgatcatggtgctcggccttgtggctttcgtattcgacaccatcggcggcgttctttttgccaaggtcctgaacctgttccgcaaggaaaaaatcaatcccatgataggcgccgccggtatttcggccttccccatgtccgccagagtcgtacagaagatggccatgaaggaagatcccggcaacatacttatcatgcaggcgaccggcgtcaatgtttccggccagattgcttccgttatcgcgggcggcctggttatcagcctggtttccgcttatctgtaggacggacgatttcagcctggtttccgcctgtttgtgggacggacgatttcagcctggtttccgcctgtctgcaggacggacgatttcagcctggcttccgcctgtttgcaggacggacgatttcagcccggtttcctacctgtttgcaggacaggcgcttttaaccgcaggttaacttactgttacggaaaggagtattttttatgtggaataattttttaattaccctgtccatcatgggaaagggtatggttggaattttcaccgttatcattattatcagcctggtcgtggctctgatgggccgtcttggcgccgggaaaaaagaagatgagaataaggctgaaaaatagcattgtatttcagccggcaaaataatgtaacaattcagataactgaactttctggaatgcaagttcggttctggaaagcaagttcggatttagcatcaatattttttgagccattacaaaatcccctccggtgtatatctcacaccgaaggggattttattttcatttaaagttttacagtccgacgccttcatggctggcgcaaaatccagttcccaggaccgccgccggctgccggccattaacgattgccgaattatgggccgatgcccgcgctgttacatattggcggggacttccttcctgtgggcttccagactgccgtcctttacatctataaggatggtatcgccctctcccactgcatcctgcagaatcagcttcgcggaaagcgtctccacatacttctgaatatatctcttcagcggccttgcgccgtatgccggatcatatgcattatccacaacaaattcctctgccgcaggggtcagctcaatcgtcagctccctgtcggaaagacgtttgttcaaatccccgataatcaggcggattatgcctccgatattatctttggtaagcggcttgaacagtatgatttcatccagacggttcaagaactccggcctgaaatgagcgcgcagatccgccattacataattttccgtttcctccgtaatctcgccgtcgtggctgatgccctccagcagataattggctccgatattggaagtcatgatcaggatggtatttttaaagtctaccgtccttccctgggaatccgtaatccggccatcgtcaagcacctgaagcagcacattgaatacatccggatgggctttctctatttcatcaaacagcaccaccgagtagggctttcttctgaccgcttcggtcagctgtccgccttcttcatagcccacgtatccgggaggcgctccgatcagcctggacacggagtatttctccatatattcactcatatcaatgcggaccatattgttttcatcatcaaacaacgccgctgcaagcgcctttgcaagctctgtcttacctacgccggtaggtcccaggaacaggaaggagccaataggcttggtagggtctttaatgccggccttggaacggataattgcctctgtcaccttggtaacgccttcatcctggccaatcaccctcttatgaagctcctcgtccaaatgcagcgtcttgttcctctcgctctccgtcagcttggaaatcggtatgccggtccaccgggacacgattctggcaatttcatcctcgcttacactttcatgtaccagggacagatcttcatttttaaccttctcttcttccagctccagctgtctacgtagctccggcagccggccgtagctcagctccgccgctttttccagatcgccctctctctgggcgatttctatctggctttggatggcgtctatctgttcacgcagcttcgacagcttctccacgcttgccttttcattatcccactgggcctttctgttctggaattcctccttcagctccgccagttccttctgcaggtccgtaagacgctcctggctcagccgatcctcttcttttttcaacgcagcctcttcgatttccatctgcatgattttacgctgaagttcatccagctcggtaggcatggaatccagctccgtcttaatcagggcacaggcctcatccaccaggtcaatggccttatccggcaggaaacggtcagaaatatatctgttggacaggatggcggcgcttaccagcgcgttatccataattttcacgccatggaatacttcatacctctccttcagtccgcggaggatggaaatggtgtcctccaccgtgggttcatccaccataacaggctggaaacggcgttccagtgctgcatccttttcaatatactggcggtactcgtccagcgtggtggcgccgatgcagtgcagctcgcccctggccagcatgggcttgagcatatttccggcatccatgcttccttctgtcttacctgcccccacaatggtatgcagctcatctatgaaaagtataatctggccttcgctgttcttcacgtcctcaagcacggccttcagacgctcctcaaactcgcctctgtacttcgcgcccgccaccagcgcgcccatatccagtgcgaaaatcttcttatccttcagtccctggggcacatcgccgcgcacaattctctgggcaaggccctccacaacagccgtcttgcccacgccgggttcaccgataaggaccggattgttcttgctctttctggaaaggatacggacaacgttacggatctccgcatccctgccgattaccggatcaagcttctggttcctcgccttctccaccaggtcctcgccgtacttctccagcgtatcataggtagcctccggattgtcgctggttaccctctgattgccccgcactgtggaaagcgcctgcagaaaccgttccctggtaacgccgtattcggtccagatagccttgatttccttattgggatgcttgatcatgctcaggaaaagatgctccacggaaacatattcgtctcccatctgccttgcctcatcctctgcggaggtaagtacctgattcagatcccttcccacataaacctgtccgccctgcaccttgacacgcttgctcaccgcattttccacccggttaacaaagtgctccttctgaatacccattttctcaatcagcttaagtatcaggctgtcttctatggtaaggaggctgtagagcagatgttcttcttctatttcctggttgccgtattcataggccagcttctggcaccgttccacggcttccatggatttctgtgtaaattttgaaatattcatacacattgccctcctgtatctgcatttgttttatttgttctattactactataacaatagtgtgaactgttgtcaacacctttttttaattaacggtaaccaacttccgcaggcacgatgtccccccttgttttccctcgaaaacagaggtacaatctataatataattatccgttcagggtaattatggaaatttataaatttttctgaatatacataaaaaaggaaatcccgcatatcatgaagacaaaatcctatgaaatcgacatgtgcaacggtcccctaaccggaaaattactgaaatttgccgtccctcttatgttttccggcatcctgcagcttttattcaacgcggccgatattgttgttgtgggccggtttgccggccatgaggctctggccgccgtaggaagcacaggctccctcatcaacctgctggtaaacgtattcatcggcctctccatcggcaccaatgtcctggttgccaactatatgggcgccagacacgaaaaggcggtcagcgagacggtccatacctccgtcctgctcagtctcctgtgcggcacctttctcattttcttcggcatcattcttgccaaaccgctcctgaccctgatgggaactcccgataacgtcctggggcaggcagcgctgtatatgcgtatttattttgtgggaatgcccgccaccatgctttataacttcggcgccgccatactgcgcgccactggggatacccagagacccctgtattttctgtttgccgccggcgtcatcaatgtggttctcaacctgatttttgtcatctgcttccatatgggtgttgcgggcgttgcaacagccaccgttatatcccagtgcgtttccgcactgctggtgctgcgctgcctgattcatgagacaggatgctttaagctctatctgaataagctccatattcataaggataaactgatccagatgatacggatcggactgccggccggaatgcagggcgctgttttttccatttcaaacgtcctgatccagtcctccatcaattccttcggctccatcgccatggcgggaagcactgcctccagtaatctggaaggcttcgtctatacctcaatgaactccttctatcaggcttccctgagctttaccagccagaacctgggcgccgggaaaaaagaacgtatcaacaaaatcctcattacctgtgagctgctcgtcttcactgtcgggctggtcatgggcaatgccgcctacttcctgggagacaggctgctgcatatttattcttccgatccggaggtcatccaatacggcctgatgcgtatgcaggtcatctgtacggtgtatttcctgtgcggcatgatggatgttcttgtgggaagcctgcgcggcctgaattattccgtgctccccatgattgtatcgctggccggggcctgcgggctgcggatcgtctggatatttaccatcttccagtggcaccggagcctgtttgtactctacctgtcctatccggtcacctggcttgtaaccgccatagcccattttatctgtttcattgttgtcaggaaaaaattagaaaaagaaaaataactgtacggacgccggacagttacgaaaggataacctatgagctgggaaattgattttttaaacgctgtacagcatctgctgcgaaatgaatttctggatgtgattatgccctttatttccgctctgggaaatgcgggtattttctggatcctgcttacccttgtgctgcttattatcccgaaaacgaggaaaacaggccttgcctctgccattgccctgctgattatgctcgtaaccggcaatatgatcatgaagcccctggtagcaaggctgcggccctttaccgtaaatacggccattgagctgctgataccgccgccgctggatttttccttcccctcaggccatacctttgcctcttttgcttctgcaactgccattatgaaaaacaacaggcgttttggcataccggctctgatcctggcggcctgtatcgctttctcccgcctttatctgtatgtacactatcccacggatgtatttttcggccttatctttggcgtccttgcaggtcttgccggctgtttcctggccaacaggctggcgcccaggctgcatatttcctgaccgattcagggcggcggatttccgttgccctataattttgcgctgcctcttatttcggccggaagccaacggaaaagcctgcccgccccgtcggccgcaggcagaaccttcctataaaataataaaaaagcaggatcttccatgtggcggaaaatcctgctttcttattattttattagaataaccggctgaattattcagctgctgttgtagactctgtagctgtctcagtagcttcagcttcggtagaagcagtttcagttgcttctgtgcttgcttcttcagttgtagcttcttctgttgttccttctacagtagcttcggtggaagctgcttctgtgctctcttctacagtagactctacttcagagctttctgctacggagctttcaactacggactcagttgctgctacggtagattctgcaggtgctgctgcatcgctggaaccacaagctaccataagagcggatgtcataactgctgctgttaaaactgctactaattttttcttcataattaattctcctcctaatcgaacgctcagctggatatccggctgaatctttattacgaaaatgagaataacatgtttctctaaacttgtaaatagtttttataaacttttttaacaaattatgaatttcataagattttgttcacagttcgtacacatttatcgcagttttctccatatttattcatatttccttatttttcgcggttttcaggcagctgcagccgcagtcaacggcggttccgctgtggaatttatgtccgtactatgttacacttagtgcagatgcaccggatttaccctggtacaaaacactgtattttcttaaattaacacaatgttactgttcacgttcaatgtactgtattaactgatttggagggaatgctatgtcttcttatttactggaatgctgcgttgattccgcagaatccgcactgctggcggaaaaaggcggcgccgacaggcttgagctttgttccaacctgattataggcggaaccacacccacgctggctctttaccgccagatccgcaggcacagcagcatacggatccatgcgctgatacgtccccgttttggcgattttctttattcccaggaagaattccagataatcctggaggaagttaaacagttccgccaggcaggtgcggaaggtgtggttatcggctgccttacgcctgaaggaaggctggatatggaagccatgaaacagctgatggaagcggcggagggtatgtccgtaacgcttcaccgcgcttttgacatgtgccgggatccgtttgaggccctggagcaggcaaaggccctgggaatcaacaccatcctcacttccggccaggctccgtcctgtctggagggcattgagcttcttaagaagcttcaggcgcaggccggccctgatctcacaattctggccggcgcaggcattaacgccggcgccgtacgcacactgctggagcagacctccctgacagcctatcatatgtccgggaaacggattctggaaagcggaatgcagtttcgtaacccccgggtatccatgggcctgcccggcatgagcgagtatgaaatctggcagaccgatgaaggcgctgtacgcgctgtgcgccgtcttttggacgaggccgcccggtaatccctgcacagccatgtacggcgtctgcgccctgccgtaccgacatgggttatctttaaaaggctttataaaaaaacagaagcgccggagcagccctgcccggtacttctgtttttttgattcaatgtaactgttctaaacctccgcggctgctgccttacgcttcgcacttccagaaatacgcgctgtagggcgcaagctggcttcctccgccaaaatcgtggttttctcctgaaatcagatccaccgccatgccgcagcccgcatcaaagtgagccgtatatggctcgctgtccgcattaattgccacaagcaccctttccccgtcggcagcgcgttcgaaaatacattgcttattggtaagcaccaccgaacggaatgcgccgtaattgagcgcatgggagttctttttagcctcagccagacggctgatgaattcagacaattcattttccacgggcgcttcgaagcaggccctcagcgcctgatccccttcacttttatttcctttggcgccccattcacttccataatatacacagggaattcccggcatgccaaacatcagcgcatagatcaacggcagatgcttctcattggacaggatgctggcaattctcgtaacatcatggttatccacaaaggaaagcagatgcagccctttgtaaagcgtccagttttcgggaccgaactgtcttaacaatgaatggacaatttcaaacaggttcatgctgttaaagctggaatacagccccttataacactcataattagtggaggaatgcagcatgccgtcattcaccagcaccttataatccccgtgcagcatctctcccacaaggaagaaatcctccttcagcccgtcgcagaagctgcgcagccgtcttacaaaatcgtgatccaggcagtaagccacatccagacggagcccgtcaatatcaaactcctccacccacagcctgatgctttcaaaaatatggttgatgacctcttcattccgcaggttcagctttaccagatcgtagttgccttcccagccctcataccagaggccgtcattgtaattggagtttcctccaagattaatgtggaaccagttaagatagggcgaattctccctgttcttcagcacatcctgaaaggcccagaagcctcttcccacatggttaaacaccccgtccagaaccacgcggattccttcctcatgaagcctggagcaaacctccttaaaatcctcattcgtgccaaggcggcggtccaccttcctgaaatcccttgtattgtatccatgggtatcggattcaaacaggggggaaaaatatatggcatttgcccccagctttctgatatgtccgatccagtcaatcaccttccgtattcccgcagtctccggcgcctgctgtgtcccgtcgttttcaaacggcgctccgcagaagcccagaggatatatctggtaaaaaacgctttcgtaagcccacatcgctgtgtcctccttttttcttcttttcagggaaacccgcaaaaatctccgcaataaaagtttcccgtgcaagtataacatataccggttgcactttccactgctttccgcacaggtatttttccatgtatccggtgataattttccacttatccagatgtgtggataacataaattcacagtattttccactcctataaaaaggggttttttgtggataaggcttctgaattatccacattgatttacataactggagtaaccacagggtcatttttactcaatatcgaccatcatgtgaaaatgtgcataagtaccaaatttcttatttattcgacattatctgcataagaaatccccagtttccacatagttatccacaattcatggcgccataaacaagttttccacaggacatttccgaaaaaaatcgtctccgtttttggtaatccgcacattccacaattttatccacatcaacataataattccctgaaattttatcttttcacaaaacaaatcctgtgctatactgatttcctgccgccggaaaagcggctgaaagcaacccggaaaagatacctgatacaggagtattttttatgataaaaatcggatctcatgtaaaaatggcaggaaaggaaatgctgcttggttcggcgcgcgaagccgtgtcctacggggccaacaccttcatggtgtataccggcgcgccccagaatacaaagcggaagcctgtcagcgaactgaatatagatgctgcaaaagattatatgaaacagaacgggatcgaggattttgtagtgcatgcgccctatattatcaatctggccaacacggtaaatcccgatacctactccctggctgtggactttctggcgctggagctggaaaggaccgccgccatgggcagcagcgtgctggtacttcatcccggctcccatgtgggcgcgggaagcgaggcgggcatccgccaaatcgtccgggggctgaatgcggtgctcaccccggatacaccggtatgtatagctttggaaaccatggccggcaaaggctctgaaatcggtcggagctttgaagagcttgccgccatctatgacggagtcgcctgcagtgacaagctgcgggtatgctttgatacctgccatgtaaatgacgcaggctacgacattgtggataactttgacggggtcatggaggaattccaccggatactcggcagggaacagatcgctgtttttcatattaatgacagcaaaaacagcctgggcgcggcaaaagaccgccatgccaatatcggagagggcaccatcggcgccgaagcgctgcgctgtattgtacaccatccggatttccccggcatccccaggatactggaaacaccctaccgtccggatccggaaaatcctgacaagacgctccctccttataaggaagaaatcgtttttttgttacaggaaccagaaggagctgatgattgatccagatttttaggatttctgttgcaacctaagcatatcccgcagaactccgtgcttcttacaacacgattttctgtgggatatgcttgttttttcttatagccgcacaattctcaaagagactatgaccgactgatgcctgatttttctactgctccaacagatgtatttgtgagcaacagactttaccatactccacaaagatgccgatatcccctgtcccaatctcatagcatcttgagacaagagctacatcctctacatatgccagcataatattgccgcttaccaccagcctgatctctgcactgttatttttaaatgttattggcctttcgtcctgataaagctgatctccatccaccctgttatagcgatccatcaaaattcttcccctgcctatttccaaacggagctggcaccattttttcatatcagggtccgtatgtatcatcaggcctgccgtgtctgttccttcttcccaacttattatggtatgaaacatacaagtatccttcaatttgccaagctcacaccagccaaagccatccggtacctctcctatcagcctgtcctcgtccttcagaaaagcacctcgccttggagtcacttctatcggaagcattttttcaaacgactgttcaattgtatccggcagttttactcccagtcttccatcctcccgctgtaccagctcatgtacaagaaggtttcctccccatacatgtctgcctctgtcactgcagttttcccgtatagattcccagcccaccatatatcttttcttcccgtcagtaactgatttagctgcatagaattcccgcccgtcaaacatatcatcaactgccgggactctccaaggaccatcgaactgatccgcaatccgatatctggtttcccaccagcgtgaataatttgaaaaagtgagataccatttatcacctatctgaaaacaatcatgacattcatgtgtaataaaggtccgcggcgcatacagggttttataatgctcccagcttcttacatcctctgatacatatactgccgtgcagccggagtgcagcagaattccatctctttcttctgccgtaatgagcatgcagaatttctgaagctcttcattccaaaacacatgaggatcacgccaatgcaggtttccatagaatctcgtatccggtctaaagaagaatgatttatccttttcccagattttaagatctctgcttacagcccgcataataacctgttcattcctctcttcgtcaccggcatttccttcacagaatccggtatagtgaaagtaaaatattccatcatgctcaaagacacttcccgttccgatatgccagtcctgatcctcaggagaaccgttttgaagtaccagacttggagcttcaaagctcacaaagtcctttgtctccaccatataaacacagtacttgtacaaataaaataagtagaaggttcctttccagaaaaatggcataaagtctccgcacatttctccgtggggcattccggggtactgctcttccggcgtataaaaaatattataatttcctttcatcctgtctgcctttcccagttataatatataagtataaaagcctttttatttcagctcaccaaaggttgtgttataccagtcgtttacttctgcggtaatctgatcaccgcccaactccttccaactctttacaaaatcatcaaaggtatcaggagactgcgttcccataataatatttacatatgtctctgcctgcatcttgtccatagaagaaagattggtgctcatggtaggagtaggtgctccaaagaaaacggactgtaccagcctgtcatttgccttataatcattgataattgtattccagctgccttccggcccaatgaatttataataattccacccaagagagtcagcccctttatccattccgttgtcaataaaactcttaataaccttatagtatctggcggcttccgggtgaatctcttctatcttggaatctccattcagagtatctttaatttctttataataggtattacatttctgtattgcaggatccatggcaaatgctgcatattccgcaaaattaattccggtagacggatcaacgccaaatgtattcagtgtctcttcagaagcttccagtgaattgattttatcctggaaaacgtttgctattttcacaagagcttccggatgctcacattttgcatttgctgcataataacgtgaaattcttacataggtaacaggctttgccggttcggcgccagctgatacaatcggataacactgccagtccgcttcaggatcgttttcaatattactcttacaggctccccagggcattccctccagaccaaagaacattcctaccttacctgctgcaatatcttctcccagcttaaccgtatccttaacaccgaattccggatctatcagaccatccttatacatctgattcaactgaatcaacgcttccttcattccaggatttatgcctgaataggctatctgtccgttttcatccttcagccaggccttggaataagctccatatgctgcaaaaaaaccttcatagcttccggggcttgcgccgtcatctttaacaatatctttctggaacccgattccccatgtgtcatcttgtccgttgccatccggatcatcataccggaatgcccttgccacctcaatcagctcatccatagttgtcggtgcttccaggcccagattttcaagccagtctgtacgtatccagagcaaatcgcaggtaccgtcagccgcagacagctggggcaatccatacagctttccatccacctttgcagaagccagctgaattccaccatcaacctctattgtctccttcagaaggtctgatgcatacgtatcataggcatccgtaatatctgccaacattcccgcattggccagctctgaaaattcctccggcggcagatccatcaaatctggaagatcattggatgcaatcgccatcgtcagcttctgtgtgtaatcgtcacctgccgctgcaattgtatatttcagggtgattcccaattcatcctgataacatcttgaccacacattgttattgatatcatcatcgcccacatatttctccgtaccattcagcttatgcatataggtcagctccacattttcatttttctcctgtgagctttcctgtacactttgggctgtctggttttgcgctgtttctcctccctgactgctgccgcaggccatcagtgaagccgccatcgccgctgtcaggaacaatgctgttacttttttgttttccataagagtcctccttttctttatgcaaaccggctgtctgccggtatctgcctgtattcacgcaggggcggcttacgccctgcgaagtttttcgccagtgacttattcctttacgcttcccattactacccctgatacaaaatatttttggaggaacggatataccagcagaatcggaaccgtacacagaagaatcagcgctcccttaattccccgtccggttacctccatcaggtgcggattcatcataagctgttcagaagtaatttttgttacatcaaattttagaactacggactgaaggtaggtcattaaaggatacttctccggcaaattcatataaatcagtccgtcaaaccatgcattccagtgattgacaattacgaaaagggatactgtcgccagtgagggctttgagaggggaagatatattttccacatcgttacaaaccaattagctccgtctaccagtgcagcttcctcaatagccttcggcagtcctctgaagaagttcagcataatgagcacgcagaacatcggcagtgcctccggcagtatcagcgccagaaaagaatttatcatgtgcattttgctaacgacaaggtaagtcggtatcagtcctccattgaaaaccattgtaatcagaaaaaaccatgtataatatttcctgcatcggaaggttcttggatcatccttggacagcggatatgctaccagaataataagaatcaggttcaccgcccaacccagcaaaactctggcaagcgtgatgccgaaggattggtaatactgtttatttgacagtatgtactcatatgccgccgtgttaaagcctttaggccagaaggataccgcattcgcatccaccatggatctggcgctgaaggaaattgcaaacagattaatcagtggcaacagacaggagagactcagcaatcccagtatgatataattcaaaaatacaaaaatttttgcggacggtgtttcttttattttcatttctatacctcctgcgtatcgcagaattacctgcgatactgcattaataagcagtttgaaaggctccttcaaacttatgctcctatcctcttcatgcctgaatccccttcggatatcagaatactttatatcccgccagcttatctgccagcttatatccgaacataatcagcacaaaggaaatcgccgatttaaacaggccgaccgcagttgcaagatcgaatctggcttctattacgccaatccgatagacataggtatcaataatatcgcctgtagaatatacctgagggctgtacagattaaaaacctgctcaaatcccgcctgaagaacattacccacactcaggaccatcatgagaaggatcataggcagaatacccggtatagtcacatacagcacctgcttaaatttacctgcaccatccattcttgctgcttcataataggtaggatcaattcctgtaatagccgccaggtatacaatcgttccccagcccagttccttccatatatccgttgccgccatggtatagggaaatacgcctgaatcacccagaaagaaaactgacttcattcccaacgttgttatcagctgatttacaattcctcccgaaggcgaaagtatatcaataaaaatgcctgccagcgctgcccatgaaataaaatgcggcagatacaggacggtctgcaccgttttcttaaaatgccttgcccttacctcattgagcaaaagtgcgacaagcaccggaaatatcagattaccggccattttcatcacagcaataaaaatagtattccagattacacttgaaaagccgggcagtgaaaacaggtatttataattatcaagtcccacccatttctgatgaaatatcccttttaagggagtataatcctcaaatgccatggtaataccggcaaatggaatgtaacggaagataaatgtaatcaccacagccggcagcagcataatgtgaaacggcagttccctatgaaaccacccttttttcttttttacagcgacttctttcatatcatcccttcctttctgtatttccaatatatcagtatatattcgcaaaaaaaataaaacgatttttacttttatactaaaaaaaataggtaacagtccaatcgaactgttacctgaaagcagtactgcgccagattctcatcccatatcccggcattcctgtggcgtcatgccatagtgtgccctgaatatttttataaagtaagccggattctgatatccgcatttttcagcaatttcatacaccttcattctggtgctgcgaataagccgcctggccaaatccatgcggcagatttctatatattccctgatactcgttccttcaatctgcttaaaaatacgggaaagatacactgggttaaaaccgatcgcctgcccgattaccggtaatgaaagatcctctgaaagatgggaaagacaatatgttttcgttctttcggttatactcatcattgttgtctgttgtgtttccatacagatttcctgaatggacgaagtcagtcttataatgtactcagccgcctgctcccaggtgacaaaggaacccggatcaaaaagctccataagctggatcctggaagccagttgcggcctgatattcttcttattaatgtaggctatcagaatattgcccagcgagtaataaatttccaacgcatacagggaatgtcttttcgcttttaccaggattgaaagaatatcctgaagtaaatccgtaaaagcaggaaaattctctcccgaaagaaattcctccatcatacgtagcttctctgtaatgggcgtcagcatctgctcaaaatcagactcttccccgttaaaggaatcactgatataaagttccctgctttccataataatgctgttttcttcattaattgcctgacgctgcatttcggtccacaattcgctgtaaccagagcacaattctttccatcccacactttcccttgcaatcccgaaatacatcaaaagccccaggcgcagttgaatcattttctgtatatccaatgccgaaacaaaaagcaatgcgggcagctctttatcttccgattccaacagccaaacaaaacttttccggtacatcaccttatgaatataggatattttatccccgaaggccttctgcaaaagctgcaccaccgtttccaatattttttcctgcgttatctgcgttaccttctcctgcagtgttcctatcaacaggagcagtttgctgtcctccggcagcggattttccagttccatcatagcatcccggaattctccatccgcagcaatcgtcccatccagaatatgtaccagcgcctgctgcttaaatgccggtgccatataggaaatcttagactgcgcacttttatattcctccataaaaagattttcagagtccagcagctccgtcatttttttcatcgcctggacgataataccgtctccctccgttttcagaatatagtcatctgcatcctgctttatggctgaataaacaaaatcgaattcatcataaccggaaaggaaaaggacatgaaggtccggtttgattttccgcatttcctcagccatttcaattccgctcattttgggcattttaacatcactcactacaacatcaggcattctgtacttaaatatttccagggcttttttaggatgatagcagttgtatatctggaaaatatcagaaaattcttcctcaaacaattcctttaagccatcagaaataatcgcttcatcatctacaacaagcatggtatattttttcttttccctcaaccttactctcctttcacatatcagaatattctgtggcaatacatccgctacagccttacatgcagacttaccttcaggcctcctaatactgatttatccgtttccagagatctttcctgtccgaaaaaaacattcagcctggtattaatattcatcaaggcagttatatcctcttccttctttgccccataaagcttttttctgatttcctcaagctgcttttcctccattctgcctgaattctctacatgaatcagcaattcctcatccgcttcctcatagcttaccttcagttttacttcttcctcctcttccagctcactcaccacatatttaaaaacattttcaatcaacggctgtatgatcagtctgggaaccacaatataattatagcgctgaggaagctccggaaaatccacatggatgattccctgataacgatatccctgtataatggcataagaacgcgcatgactgatttcatccgaaaggcttttattctctcctgaatccctgtttatgtacttaaaaaatttgcccagattttcgcagaccaacaggctcccctctttatctcctcgtttaatcattcggtataaaaggaaatagctgttgtacataaaatgcggattaatctgtgcctgcagatgcttataattggcctggttcaccagaatctcctgcttcagttcccgggataccagagtgtcaatcctctccgccatataattaaaattctgataaagcctggtaaaaacaacgttatttttagtaaccggtattctatagctcagattggactcctttatctgttcaaatgcatccactaataaaatttccaacggctgaaagactcttttgtaaaaaagaagaaatgccacaagaatagtgagtacaattatccccgcaaacaggagtatatttgttatcattttttcctgtatcaagtgaagaaatccctgatcctgcatataatacaagctgaaaaaatctccatcatcttttgaattcataaacaggtattcctctccgtccaaaaggattttctctttattttcactgggttccaaattctgaaatgcaatatccccggtagtaaaatagattgtgtccttatccggatttgtcataaacagtacatcggcatccatcattttcgcatactgtagctcctgccggataagacctgtattcagttcaattatgaaaattcccagtatattattttcagaccatttatcaaaaagatagtttttattcaatatttcaaaaatatatgcttttccattttccatatggattaagtcattccgctttccatttaaaagaaaagcataggcatcctcatcaacgatatcatagccgtccctgtctattttgagatttttccccggcagaataagtgtgctggaggagacaaaggaattaagattgtctatttcaagacatcgttttctgatatcctccatcattttattacgttcataactgtttacaaaatcatactggcaatataaatcctgtacgatgtcctctttcacagccatgctcgccgtaatcttcagcgtcgtcaattcatcattgatattttttgacaggtagttgattctgtctctttgttcctgttcaatgatttcagaataataccttttttctctgatataagtgatcagattgaagcaaatactcactatggcgaatactgcaaaaatcagaagaagccatttaaacagatatctgataaaattattttcccttttcatctctattttctccatgcttctccttccgacagaggacagactttaccggcaaaattcatccagttcctttatcactttatccactgcctctttttcagccaaaaattccccctgcccatcttttacgataagataaaaatcctggttatatgggtaataactgatttccacgtttttcagtttatcagtatttctgataaaaaacaattgaagcaccggctcaccctttttctctttcttccctgcttccccctgaatggttatggacagaagcgatgcatacatgtccttgaaaccatctttctcttcctgttttccctcctgcatatatacctgattattttcactgtcggtttccattacaaaggaggctgttgttttcttagtatgtatcttaagaccatctattgtcgtcaaatagactaagtttgcgattcccataagaaaatccgccggcttcagctcagtcattgtttccaccatagccgaatccatttcatatacttttccggttattttctcttttacataataatttccattttcatttttctgtccaattagaaaagtcatcttacccgtatcagaaaactcttcttccacagaaagacctgattcaataaataaaggcttctcacagtaatcgatataagtccaggcggcatacttctcaaaaaatgcataaatatctgatacattaacgagctgacgtgacagataaggtgccgttaagtaccattcctcaaaatcaacctggttttccgaggggcccttttgaatttcaaacactggttttccgtttttatatatggcaagacgtctcatattttcacggttccctgcctggactttcccggttccggctgcctccatcagtataacggcttctttggttgatacaggaaactgatttctttcagtttctcttgcctgaatcttattataccggattcctccggtagcaactgctgccaataaaaggaaaataatacttcctgctatcactgtcttcctgtttttcatcagaaatacctcccggaaatcctctgtataattttctttatctggttctacagaataatcttacctttaaaaactgatgtaaaaaatacaaaaaatttgatttatatagaaaaaagtatacaaggcattcaagtatcaactgtcaccttgccagtattccggaaaccatagatatcctatacacaaagcgcatatgtttctgcatgaaaataaacattgaacaaaatacgcctatgaatatactcaactgattggttaaggaatggaaaagaaccacacaggccgccggcagagtctcctctgccggcggcctgcgccgtccttttctatagccattcatcccagaaacgttccacccggcgggccacctgatccgccgttaccacttcataggtgtcccattctctggggaacagccgctgataggcccctcccaggaaccggtcgtccagcagggccacaattcccacatcctccgccgtccggatcactcttcctgcagcctggagcaccttattcattcccggataccgataggcataatcaaaaccattttttcccatggcatcaaaatagctcttcagtatctcccgttcattacatacctggggaagcccggtccctacaatgatcgcgccgatcaggctgtcgttcttcagatcgatgccctcactgaaaataccgcccattacacagaagcccagcagactcttttcctgctcctcctcaatctccatatggatcatatcccccagctcacagcctctgttcccttcgaaacgcccgaggaactgttctctgtcctcctcactcataatatcctcctgaatgatgcattcttctttttcctcatccaggaaatattcttcgtaagcctcatacacattctgcaaaaaggaatgggaggggaagaaaatcagataatttccatacctcgtttttgtaatttcatgcagataggttgctatattgatatactccgttttggagcgcctggtatatttgctggttacatcgcttcctatatatagtgcttttttcttgggattaaaggttgactgtgcataaacctcataatcttccttattcccgcccagaaggctcttataatactgaatgggcagcagcgtggctgaaaacaggatagtgctgcgcgcccgttccatacattccttcagatttacggaaggattcacgcagaacagcttgaccaggaagctgtcatcctcctccagctccgtatagatgacataattatcatccagcctgtcatacatctcaaggaagtgggaaacttcaaaataaaaatccagaacgtcctccctgacagggctctcatcatgatcctccaggtatttctccatggtttccgaaagacgctccaccgccagcacaaagctgtctatggaagacaccacctggcagccttcgcattcccgtttcagcggaagcagctccctgctgcatttatccagctgatgctccattttggaatcatattccttaacaattttcttcagcgcaaggaaatcctccttcacaagcactgcgctgtacatttcacgtccccgttccaccagattatgcgcctcatcaatcaggaaaaggtactgtccctgtactccatcactgaaaaaccgttttaaataaacatggggatcaaacacataattatagtcacatatgatgccatcggagaacaggctcatgtccaggctcatttcaaagggacagaccttatatttcctggcataggtttccaccatctccctgttatagtggtcctcatgggtgagcagatcataaatagcttcgttgatcctgtcataatggccgtccgcatagggacaggcgccgggattgcactctgtttcctccataaagcatatcttttccttggctgtcaggattactgtcttaaaacgcagccccttatcacgcagcagctggaaggtattgtccgccaccgtgcgggtgatggtcttggctgtcagataaaatatacgctctgcctttccctctcccaaggcctttaccgccgggaatacggtggaaagtgtctttcctacgccggtaggcgcctcaatgaacagtttccgcttgtggacgatgctctggtatacataggtggcaagctccttctgcccctccctgtagggaaaaggaaaggccagctgtcttatggacgctgtccttgcctcctgccactgactggaaaaatccgcccacttcttatattcctccagaatgccgatgaaccactcttccagctccgctctgctgtgcgtactgacaaaataccgcagttcttccgtttccatattgcaataggtcatacgcaccttcatctgtgcgctgtcatgatctgcggcatacatgaaagcatagcacttcgcctgcgccagatgcacatccaccggccccttcattttctccagatcccggtaggttcccttaatctcatctatagtcacggtttctccgtttattacgccgtcggccctgccctctacgatcagatcataggacggtgtattccacacataacgcataaccacctctgcctgatattccgatcccattctacgctgtatcatacggtgtatccgtccgccctctgccattgcattgtcaggcgctgcctttttccggttgtctatactgccgctgcgcaggataaattccaccagattgcgcacagatattcttatttccacgttaagccgtcctccttatttgttgcctgtaaaaagaatcaaaaaactccctataaagatagtacacacttctttacagggagtcaaatccattatgctttggaaagacagttaaccggccattgcaaattttctgaggtagttttcaaattttttatcgtacccatggcaggatacggttaacacacgggtaaggtccaggccataaacaccaagaatagatttagcgtctactacatagctgttatacgctatgtcaatatcgaaatcataccttgaggcttcatttacaaattcctgcacctcgtccggtctcagcacaattttatactgattgattccattcatacttaccacacactttcatcctttcataaaatagaaactgctacaaacacggcattttcgccgtgtaccttcttagatttatcatattatacagcattggcggtaaatgtaaaccccccatttttctacataaaatgacagtaaatacggccatactgcataatgtcacccgcggagcaaaatcaaactcctttctttgtttaaaagtgtgatacccggcagttaccggcttttccgccggcctgtcttctgctcattgtttacaaattccaccatatattcttggaacctgtaaggaagcatctgccgctgcagtttctcattttccctttcctttatcgttatcttacggcagaaatacctgaaaagttcctgaatctgcctttcctcctcgctaaactccagatcctgtttctccggcccgttctccattcccgccaaaaaccagggcttaccggcctgatggattccataaagcttccttcccttatcaaagataatgaaattctcttttggaaaacgatctgcaaaatggggcatcataaacggcaccacattattcttcggccctatttccccaaacaggatgcccccggccgtttcctcaaacctgaggaatcccagcagatgatgggcttcattcccggccgccctgctcagttcaaaagcacggtggacatagcggtttcccagatgatccatcagactgccccggatccgtcccttcagcccttccacaacagtctgatagacagcctgccctttatccgtttcccacgaagacagcgcataacagatctgttcatagcattcctccccaaaccttgtgagtattgtccgtcttaccttgtctgccttctgtatgtccggcacaatttccctgtattcggcaaataaacacagatctccttcctctcccagctgaatccgcgtactgtcatgatcacatttctgcgcataagcctcatatattcccgtaaaaatcccctcctgggaatcctcacatatcagtatcttttccatatgccatccacctgtctccatcacctgtaactgttatacccggagggtacttaataagccattcccgccgcctgtctgatttcctgccgctgcggggcaaaacggacatcatcaaacagggaaagctgtctgtaggtcatgcctcccgcctccgcgggaagcttttccttcaccgccagcagattccgtgtgatataatcctcttctatcttcgttttatacatcatatgaccgctgcaggtaataaaatacagcgcccgcttcagtacgactcctatccgcttcaaatcctcaaagcacaggctcccgtttcttcttgcctttacaatcctctgcgcactcttcaccccgattcccggcacccggagaaggacctggtaatccgcccggttgatctccacagggaaaaattccaggtggcgcagcgcccagtcctccttggggtcaagaagcacattaaaattaggccttttctcatccagcagctcatcggcacggaagccgtaaaaacgcagcagccagtccgcctgataaagcctgtgctcccgcaaaagcggcggccctcccggcagcgccggaagatccttatcctcattcacctgtacgaatgcggaataaaaaacccgcttcaggctgaacttatcataaaggttctgcgccaccgacattatctggtaatcattctccggcgtagccccgataatcatctgcgtggactgtcctgcgggcacaaaaaccggcgcatgcctgtatacggccacttcattcttattgacggcaattccattctgtatgaggcgcatgggcgtgaggatattcttcctgtgcttgttgggcgccagcttcttcaggccctccgccgtaggcagctccaggtttatgctcatcctgtccgccaggaagcccgtcatcctcaccagctcctgattggccccggggattgccttcacgtgaatatagccctggaaattatattctctgcgcagcttatacagcgtctgatacaaaagctccatggtataatccggactgtaaaggattccggagcttaaaaaaagcccctctatataattgcgcctgtaaaattctatggttaacctgcaaacctcatcaggcgtaaaagatgccctgggcacatcattggagcatctgttcacgcagtatttgcagtcataaatgcactcgttggtaaacaggatcttcagcaggctgatacaacgcccgtccccggaaaagctgtggcatatccccgccttaatggtattgcccatacctgtcccgtctccctttcgttcatttccgctgctggtgcatgccacatcatactttgcagcatccgtaagaatacccagcttatccataatgctcatctgtctgtcggctattgagtaatccatattcctgtctctccgctcaaacggcgccgtattttaagcgccttttttatcgaacatttgttctcttttaccatattatagtacatatgttcgattaacgcaagcccaaaaataaatttgaatcctgcatgaatttatctcctgcctaaaattatcttccgtatgaaactgcctcctgccgctgccgaagctgattattctatcaaaaaacgactgccgaagcttactgcggcaatctttttttataacagcttatatgtttgacaaaagaaaagttactagtgaattgcgaagatagctggagcaagctagggtacaaaaaaacgaatattgaagatttatgtgcaaaagcaggaatatcaaaaggcgcattttatttattctatgcttcaaaagaagaactattttttgatgttataatgagaatccaaactaaattagtttatttgaccaaagcaacactaggtgaaacacctacaaagaaaagtttgtgtaatactctaaagttgatttatagagaatacattaaaatacctttcatcttagaaatgaattcgccagattttatagcatttatgaatagactgcctaaagaaaaaattgaagaattagcatttcacggtgataatgatattcgtaatatcatcaaggattctaagctacaatacaagataaatgaagacaagggtaactctgcatttgctattctatttatgccgaattctaataaagaaaaattgccatataatcatttagaagtagttgactttatgatagaagttttaattgaaagtgtatttgaataaaaaggaggaattcaaatgaacaacggattagaaggattaagtaaattcagaaattatctgattaagaattgtaaacatctaaatactggcaggtctcctgtttttatttcaataagtttaattgcaggcatttctcttgctgctggcagtgttttgttagctccaaaaacaaccgctgggcaaatctgctttggtataggttcggttactgctgttctaaatggcgctcaattaatttgtaaaaagtatatttaaaaactttgcaaagatttgaggtgataaaatgcaaaggtcagtaataaaaaaatatggaatatattcaacttttctatttgttgtaatatttctatcggtattatctgttgtgttaatactgacagggattttattcccaacaggaatgatactttttgaaatagggctatttgagcaaatatttcaatattatgattttaccccaaatgtgcaagttaaccttggggttttagaattaccaacttttttaaatattcctattagtataattgttggcattgctttggtttatattggaaaaaagacttatatgattttacgaaaatatctattgtatgtaaagaaaatatgagacaatatcaaacttgataaaaagtatcatagtaaagcaggtgaaactatgggaaagttgtagtaataacatttaaaaacgatgaagagcaagtttttcaacaaacagtagattggctgtctaaaaaatttccatgtttccctattactacctatgaaaaagaatatgcttttaccatagaacctttttccagaacatttatgaccaaaaagggagaatgtatatatttgaccgcaaaagaatttgacctcttatactttctcttttgccataaaggacaggtatttacgaaagaccaattatatgaaaatgtctggggctttcacaatgccccagagggaagcaaccttacatcattcatacgaaagctaagaaagaagatagagccgttcccagacaatccacaatacatactgactgtctggggtgccggctataatatatgtatttttactaaccttaacagcccataccatcataccgccaataaaattaatgcgcggcgcttcattcgatggcagccaggccgcttccccagaccgcttccccattctcagacagggctgtaaagccaattacatattttttaccgaattcatcatactgcctgcacacgattccttcatacgtatcctcaccgagcgtaatttttatatggtgatcctctgaaagctcccagctcccggtacaggctccctcgactctgccgtcagaatatagggttatatttaccgattcctccatttgtgtggttatctgccggccatgcttaagcagtttatatctgcccggcactgccttttcttcatacgcctccggatcctcgcccgcataacggtaaggtgagataaccggccagccttcttcgttgaagaacattctatgtacccgtacctcatggttttcccccatattttcaaaccgcgtatggaaaataataaaataatctcctgtttcttcgtcaaaatatgtggagttatgtcccggggaaacaaggcccctgcggtttttgccgtcttcgccttcctgccaggtccatttgtaatttccaatcagcttcactccatactgctccgctgtccgatcatcaaaaaagcttccgccagggccggcgcagtctatcatatcgtgtcccgcgctgtcataatacggtccgtccggcgttctggaacgacataccctgatgttatagccgccgtccgacgtcaggccgccaaaggataaaaacatgtaataatactccgtatccggattgtactgcacataagccgcctctatacgcagatgattccctccgagcagcttctttccatagcctggctgcagcggcagaccggtattctcatccatctccagcgcaaaaatccctcctgaataggagccgtatatcatccaaagacggccgtccgcatcataaaacacacagggatccaccacattgggctgcttagttgcatcataaggatttccgtcctcactctttcctgccatacctgatttcaggaaaattcctttgtccgaataaggcccctcaatactgtcggagaccgccagccccatgcaggaaagcggggagctcccttcacagttgcaataatacatataatattttccgtccttcagcctgataacatccggcgcccaaaaggtatccgtctttgcccactcaaaggcctccggcatttcattcatggcatccggtataataggatttccctttgtcactccgctcccaatcaggctccagttcattaaatcctgcgattttgccgccgcaagatgggaaccgaaaatataatagcttccattgtccttaacaatggagggatcatgcaccgtcacatttttaaagccaatatctgtatcttcttcggcagtcaggcgaatattatcaaagttctcttccgtcgtgccgcacccctgcagaatacccagcaggaatacaagtacgcacaataatgctatttgttttcccgatccctttcttcctttcattctttgccctcctaaatcactttctaaactatcaacaaataattaaattaattttgtattatataaaataatatcaaatcaaacactaagtttcaaccataaatttatggataaatacaaatatcagataattattgtatattagttttattatttataaaatattttattgtttttatttttacaatatgattttgcaaccaatttgggcaaaaaaaaaactccctcccgggcagcaagcgtctttttcacttgtctgtccggaagggagcacagctcctgcaatattctgccgtaccgttaaccagtccttcagtgctccgtttcccgttccaccgattcattcatggggctgtaattaattcttacggaaatatcctgattgtaattgccaaatcctttgccaaaaatggtcagtccgcccacatgcgccgcatcctccgcaacctccattttaaactttatcacactcttataatctaaattaaaatcctttacagaaatatccgatacctgcaagccgtctataaaggtgccggatttattaatgacgagaatcttcagcaggccatactgattccagttggggtaccaccagtcaggcgtaaatactcctcttacgctgccaaaatctcccgggcttgtccattgtgcgattttcctgccatttaagataaaggatatgtccgagggccatatatcgttgacgccgggcgcctccgaacagatttccagtgaaatggtaatctgatcgattttctgcgcacagggaataaaattcggtatcatatactctacaaagccctgtgtaagccacagcatatccgcattatatctgtcaggatgtgcgaaataccttacgtcgtccacttcgccgataattgcattgcctgaagcgaggccgcatgtaggatataccttataatctgaaaaatgtcccaccttaatatcagtctgatacacatttttatcatcagcccggccatccagatcgaccaggattttatccagatgcacaaagcatttcttctggttgccgtgtccggcagattcactggaaatactcaccagaccgcattcctccagtttctttatatggcctgtaagggctccattgctgatgttcagtctgcctgccagttcattcatgttcatcccgcggttttccaaaagcgcttcaataatttctatacggacttctgaaccgagcgccttaaaaatatccagcccttccttcagcgatttgatatgcagcatctgactcacctatacttttcatttattttagtaatgtctaaattaatatgtatttattataacagctttaagggattagtcaaataaataagctttcagataataaataccgaaaaaacgggacataaaaaagcatggcttttcctccatgctttttccaaatttacaatcattttaccgtcatgacgccgcggcccttttcatacacagcttcatacggcagcggcggcctgccagcgctgccgcgtatacagcacataccttttccccgaactgccccgctccgaattccagccctgtacggaccgctcctgcggacaggaaatttctccaggccgtgtcccctgcaattttcaggatttcatccctgaattcttcataggtttcatactgaaaaccattttcattcccctttacaatgccctccacacaagggtcttttctgcatattacaggaaggccgctggaaagcgcctcaagataggtaattccctgggtttcactccgggaggcgctgacgaacatgtcacccgcccgatagtaagccgttgtttcctccggagaaaccattccagtaaaatgaatgcggcagctgttcttctgcagatccgccagttcctccagttcttttctgtagggcccgtcacccacaatgagaagctccatatcttcacggttcatctgtccgaaaaagcttatgatttcttcaatatttttttctttggcaagccttcccaggacgaggagaaccttttgtccttcaccgattccatattgttccctgattctgtttctgtcctcatccacctgctcccagcttacgggaaggaaacgttccagacgtatacccgtgggaattaccgccaccggacgttccacgccataggattccagcagcttctttacttttgcggtgggggcaatgacaaaatcggttttctccaggataaaacgtgagaaccaggccgccgcctgcctgccccagggccttccggcgctgaaatagtgggtataatcctcatacaccgtatgatacgtatgcaccaccggaatcccaagctccccggctattttcctggcaatcaggaagctgctgaactcacactgggagtgaacgagatccggctgccattcaatcagctcctcataaaggctgctgcccggaaagcaaacggctctggcgccgggataaatcctgctgatatccacagaacgcatataataaacgtcatcttttttataggaatgcccgcagtcggaaagagtggcaaccctcacctcatggcctctttttacaagttctcttttcaaagtcagaacggatgtaacaacaccgttaataacaggttcataccagtcagttgtaatcaaaattctcatattatgctcccctctgtgctttagtgatctctatttttacagcagctgcaggtttttgctttctgccttatcctccgctaacaaactatcataaattcctgccagcgcattgcctattttggtgatgctgttttcctgcaccaaccggtacgcctcttcggtcagcctgggaagcctgccttccagaatatccggaagaagccttgcaaaatcttcctgccccctgcctttatatacggtcctgccatgctccagccagccctcatatacggggatataccttgtcaggacaggggtttccatggccattgcctccagcatcacaatcccttccgtttcctccagcgttgggaagaaaaacaaatcgctgccgctgtaggcatccatcagctcttccttgctcacaaacccgggaaactgaagattgggaagctgcgtccttacagcctttcttatctttgccggaatcagcgcggacggcgtggagccaaaccagataaaatcatactggggataccgttttgccatctcgacaaaatccaggattccttttctttctatataatgtcccacgcccagaacgactttccgggatgaggcgaggcaataagcatcgcggaaccttttggctccctcctcactcctctgatatgcagcgagatcaattccgtttgataatgcaaccaccggcttttttaatccataggtgttcagaaggcgtgcagagtaaggagtaggggtgataatcacatcaccgctttcataacaccgtttaatccaccgcttaaacagcccggccgccagatttgatcccgtaaaagaattcctgaaatcctccatggtggagtgcccgtaataaaccacctttttcccctgcatccttgccttcagccccatccacagggaatcgggaaatacggtattcagctgcacaatgttgtagtcctctccgggatcatgtgtataaggaatccccgcattctgcagcgcgcgcgcctgatgctccattgcgcggcccacgccgcttttccctgccagcttcataccgccgtcataaagtaataccttaagcatacctgcaccctctttccctttcgcctatctgataagttgaagcacctgcgtaaacagcagctgcagtcccagggaatatgccgcaattgacagcggttttcccagaagaatgataattaaaaattttttaaatgacatggaagtcacaccagccagaaagcacagcagatcatccggcgccgccgggaaaaagattgccaatgcaaaccatttatcaaaggttccgttttccatccatttcagatatttcccatatttctgtccgtcggccgcccgttccacagccttcattcccagccgccttgaaatcaggaacgcacaggccgagccgatacagattcctacataattatatataaagccccacagcggcccgaaaagcagcacgccgcccaggcatgacaccccgcccggaatgattggcaccacgacctgtaccacctgtatcaatacaaaaatcaatggcccccagatgccaaagggcttcaggaactgctccattgcttcctgggaggtaaacagccccttctgcattccgtataccgtaaatgccacgcagaaggcaatccccactgccgtaatcagatacgagggcttaatcagcattttcctgttttccagctttactttattgtattgtgccttttttactcctgccgcatattccataccttactcctgttctgtctgtgaacttttttacttatctttccttcatttcctatatcgtaacagccaaagcttaaagaagagtccggtaatttctaaatatttctttaacaaaactggtattttagcttaattgataaaaataaactgtcctgggttttattccacattgatacagctttttatccggagatatattataattgtaattgtacagaaccttcattgttactggcataatccgtattggcccgctttcggcgctgtattttgtcattttctgcgctattttttcttaagattgataaaaaaccggcccgcacaaatacaagtgcaggcctgacggataattacttccaattacagaattgttaaaagggggatatttatgatgcagaagcataaaaaaatattagtttttatattatgcagcatttcagttcatgccctactcctgacaggatgcgatgcctggcctgcctcttccaagaagaccacagctataagctctgctgaggaaccatcctccgaagaaggagacaccgcccaatcagcagaaacagaatcagctgataaaaaggcaggcagagccgcgggcactaaattagcatataaagaggtaagcagagccccaggcactgattccgttgatgagaagataagaacagccgcagacgtggagacccgtgcagatgtcgaagctgctgccagggaggatgccgtcaatttggaaattctggaacagatgactgcactgaatgaaaaaggtgaattttcagaagcgataaaagccactgagggaatgaacaaaaatggggacagtgcgcccaaaataattgctttaagaaatgaaatcataagaggaaataaagactattttgaaacgcagcttgacgcggctttcaaaaatggggatctttatatgattaaagtactgtcaaatttctttgacctgaatcgggagcagaaacgggaatataattttgtccaaaaactacagggtgagtatgttccttatgatgatcaaagcagcggcgtcagtgtgataatcagcggatatgaaatccaggtcaacggcactgttgatagatttacctacaaaatagtgaatcccttaccagaacttgaatacttcgacagccgtctggcattagagcacggaggtgaagtggaagaggtctgcgccggtctgatttccattaatcaggaaaatggaacctacaaaaaatatctctccactgccagcagggaatatcaggaaaacaacagtaaaagagtcggcggaggaagaaaacaaagcacagcatattcctaatccgaaccggaatatgctgtgccttgttattatctttttgcggtcgattcctgctccagcagctctccggcgaacaccttatgctgatgcccgctcctcccggccaggatatcaaacagaagcttcacggaggcctccgcgatatgctgtatcggctgtcggatggtggtcagcgtcggattataatagctgcacagctcaatgccgtcgaagccggccaccgaatagtcctccggcacccttttgcccgcttccacaatggccctgcaggctcccacggccatggtatccgaaagagcgaaaatggcagtaaactcttttccggaatccagcagctccctggtgaggacatagccgctttccatggagtaggatttaatttccggacgcatgtgtcggatcagctcctcgtccggcttgattccgtgatccttaagggccttacggtaaccgttcagacgcatcctgccgatactcgcatcattgggctgggcggcaagtatggcgattttctcgtgtccctgacggatgaggaaatccgtcatccggtagccttccttctcatcgtccaccgaaagggaggagtaattgtcatgatgcattccgtcaggcgcacagcctacggtggagaggatgaaggggatacgcagcttatgcagcttctcctcggagtgggaaaaatatccgcccaggaatataattcccgccaggcgtttttccttcaccagctccagggccacatccacttcatcctcgttgaattccacgtgcctgattaccatggaatattttttcttctttatttcatcttccattatctgtatggcatccgcaaaaaaaggattggtaattcccttaaccagcaccgccacgcactttccgtccgtacgcttcagatttctggcgctgttgttgggaatgtagccgtacttctgaatggtgtccataatcattttcttcgtttccggattgatgtccggatggttattgatggctctggataccgtgctgactcctaccttgcagattctggcaatatccttgattgtgatctcttccacatcttcttctatcctcatattcaaacacccgtcccccgctcaagcaggtattttctacggattccgacaggaaaccctgatttattttgcaacagtccaggacgtcccaaactgccactttattttaaaggacaaatgtggggtaagtcaaccgtatccttttatcgcggcacttatcctgcaacggctcagcctttgtctgaactgttgcattatcctttcaccgccccggcaacaacaccctcaatgatatatttctggcacgccaggtaaaatatgatgatgggaatgatggcaagcaccaggacgcccatcatggctcccatatcaatggagccgtagccgcctctcagatactggactgcaatgggaattgtcttgtactttgtcatatccagcaccaggtacggaagcaggtaatcgttccatatccacatggcctgcagtatggcaaccgtaatacaggtaggcttcagaatcggcataacaatccggaaaaaggtctgcaggggcgtacagccgtcaatcatggccgcctcttctatttccaggggaatgcttttcacaaagccgcagaacatgaataccgacagcccggcgccgaagcccaggtaaaccaccacaatgcccagcggatttccaagatgcatcatatccgccagcttggacagtgtaaacattaccatctggaagggcacaatcatggaaaacaggcaaaggaaatacagcgctgtggtaaatttattttttacccgggaaatataccatgcgcacatggaagtgcagatgatgataaccgccaccgaaagaaccgtaatgaaaagagaggtccagaaggcgtcgataaaccctgttttcttgatgccgttcacatagttttccagccccacatacatcttgcccgagggaatggcaaagggctttctgctgatataggcctttttcttaaaggagttgatgagcaccagcacaatgggaaatacataaatcaaagaaatcagcgaaaaaacaaaggtaaggactccgccgtgttttgcttttcttgcattcattattgctgtacctccttcctccgggtgattttattctgcgccagcgcaatgatggctaccagaataaagaataccaccgccttcgcctggcctacgccctcccagccggtccggccgtagaaggtattgtaaatattcagagccagcatttccgacatcttcgagggctccccgttggtcagcgccaggttctggtcaaacagcttaaaggagttggtaagcgtcaggaaggtgcatatggtaatggaaggcataaccatgggaatcgttacattcctgagaatctgcctggcattggctccgtcgatttttgccgcttcaatcaaatctcctgaaatattctggataccggcaatatagataatcatcatataaccaatctgctgccagcacatcagtacgatcagcccccagaagccataggttgaggaataggtcagcgtcctgttaaaatacagcaggatgccgtttaagagcagctgccagatatagcccagaatgatgccgccgatcaggttcggcatgaaaaaaactgttctgaaaatattggttcccttaaagcccttcgtcagaagcaatgccaccgtaaaagccagtacattgatcaggatcaccgatactacggtaaacagggccgtataccagagcgcatggacgaaggagggatccgtaaaaattttgaggtaattggaaaagccgataaatttggcgtccgttacggtagtgaacttgcagaaggacagatagatacccataataaatggcgctatgaatcccaggataaaagcaagaaatgtagggagcacaaaaatcggccagtatctttttattgcttttgccattttctttcctttcttttttgcagctgttccgtatttccacagttacattttttcaaaaaagggcgggtaatctgcgcccgcccttcacctttaatacttactgtgcatttgccgcatcgtattcagtcttccagccgtctacgaaagcagttactacgttatcccatttgcctgtgccctgtgcgtactcaagaagtgcgctgcccacaccgttcttccattcttcggaaggcatggttgtgaagttccatgaaacaggtgtcttgccggcctttgtgtactcatcgttggcaagaatcagaggattggttgactgatagccatcagcaaaggtcttgaaaggtgtaacgaagcccatcttgtttgcaagggcatccctgcctgcatcactggttacaacccagttcaggaaatcaagtgttgcctggatatcctccggcgctgcatttttgtttacacaccagtagttctcggaaccggtgcacagaccctggttttcttcaccctctacgccgatgtagataggaagcatgcccagatcttcatctgctacttcgttgtctttaatatcattgtaagcccatgtaccgttctgatagaacactgcttcgccaagtgcgaattcggaagctgcatcttcgccggtcttaccggaaaggaggctgggttcacaggtagcgtctgtaatataaaggtcaaaaatctgtttgtaattgtccagataggttcccttgattgcatccgtggaggtaattccgtcagccttgtactcataataaacgggaaggttggcaaggtgtgtcttgaatctccagtcggaggaagcatcaaagccggctgaggtgaaggcgccttctactcccaggtcatccttgtgggcctgaatgccgtctgcaaccttcttcaacgcttcgaagttattcagctcatcgatggatttgatttctgcatcgggcagtgcgaaataatcattcagcagagccttgttataaataatgccgtaggtttcaattacatatgccataccaagaacggaaccgccatccttgagcacgtaatcatcgctctcaatattcttgtaaacatcgctgtccttcaggtcgtagcagtaatccttccaggatgccaggccaacaggaccgttaacctggaacagggtaggcgcttcggacttagccatttctgacttcagtgtggattcataggtgccggacgctgccgtaaccacggttaccggaactcctgtctcatccgtataggccttggccagttctacccagtcatcagcctgctcgggcttaaagttcaggtaatacacctttccttccccgcctgatgccgcggttgtttccgctgcgggtgtttctgatgcaggcgctgcttcggagctttcctccgcctgctgtgtatcggcaggtgccggtgtgctgctctctgtccctgcgcttgatccgcagccggccagaagtgcagaaaccattgctacactcagtaatgcactaatcagtttctttttcataattacctctccttttctttgaatgcttaattgccggaaccgttatcggtaacgttgtcggtaacgtttccaattgctatggttgtatattaccacatcattttttgaattgcaatagtgtatttgtatattttttatatttatttttatttttctaaattttgatatgcactttgtataattatgagttttttccacaatttatgatgactttaaacagacttttttctgtataatacgcacaaaaaattcatttattatatattttgcagattctcagctcctttacagatactgtcacccccccctgctccgccttcattggtatatttttgctctcccgatccgcattcttatggtcagtgcaaggcgccggcctgcatagccggacatgccgacattccaaatagctgcaatattttattttcacaccttttactgcctctgtttcgggaaaatgtataaaaatacagaaggatactgacatcgggccgttcttcctataaaaaagaagaccctgtgcccggcaacgtcatttattctgcgtatgacgccgcacggcccggtcttctcttttgtgttcctgttctgttgtttatcccttccgatacagctgtttccccgccttaagccagcatatattcttccatcacagctgctgctccgtcatgatcgcagtcggctgcaactatcctggccagcgcccggattccgggaatcgcattccccacggccaccggcaggccggcggcctgcagcagcccgatatcgttgctgttatcccctaccgcaattacctgctccatgggaattcccagatgcccgcacagtatcctgagcccttctcctttattcgccttccggtcattgatttccagatttcccgccagggagcttgcaagggaaagaggaagccgggacattttcgccagcgccgccgcccgatcctttctgttattgaaaaaaagattgattttctccacctccagcggattttcctggtaaaaatcaaacagggccgccacccgcaccacgctccggtcaaacacatcgtcaaagccgccaaggccgaattcctccagcctgcccatataggccgcatccataaaggaacggtttcccataaaaaaagaagccatgatatcagcatccttaatgcaggaaataattttgcatacgagacggggagaaatgggtattctggctatattttttttctcctgcagatcatagacacaggctccgctctcacaaatcagataccgcatacccggaaaagcctccagataggtttccatctcaccaatacatcttccggtagaaaaaacaacctgttttccccgcgccagaatcttctctatcgcccgttttgcccggggcgtaatctcgtgcctggaattcagcagtgttccatccatatccagcgcaatcagcctgtattcgttctgcatccctttcttcctcccgtccgccgcaccgccggcattcttattgatattttacattgttttgcgaaaaattgaaagaatattttccttattatcgagaaaaaacatgcataatatctgcctgtatatacagaatccggattgtacaaataaaataaggaccaatgtaacgcagatgcatgattgcatccgtattacatcgatccttccaggccggttctgttcttatttcctgatattctcataataaaaaccgccgattacgccaaccgcaataatcactattgataaaacagaccagatatcccacataattttttcctcctgtataccgttgtatcttcttaattgacacaatagcataaacagggcagggatactatggtttaccggttttcttaacgtatcatgagcgggttattagcggaatcttagcaaaggcacgcttcagcaccaggcagcgccgggtaacggaaagctgtaccagcttatttttgtcataaacatcatagccgttaaaggttcccctgatttcattgagctccacagggacaccggccgctgcaagcctgtccgcataagcatttccctcatcccggaggcagtcgatttcctgtgtttccacataagcaggcggcagtcctttcagtgacggcgcgctcatgggagcggcatattccggccttccataatccccttttctcatataaagatcccacatctgccggttcagattcgcattccaccccggggagtccacaaactgccgcatggaccaggaggtcatgttcttatccgccaccggattaatcagcatctggaaacagatggacggccccttcttgtccctggcaatcaaagttacagccgccgccagcgcgcctcccgcactgtctccaatcactgcaatcctctccctgtctatccccagggcatccgcattgcgcgccacccaggtcagcgccctgtagcagtccttcacaggctcaggataaggctttccaagccggtaatgcactatcaccaccttgcaccttacctctcttgtataaacctgtgccagacggtgtgtagacggcctgtccctgagcacaaaagcgcctccatgataataaaccaggcagggcgcattcttgccgatattctccggctcataaattgtcagaccgattctgcctccgcctttgagacgcacatattttttccgcctcttaattccctttgcaggctgctgaagaaaacatcccgcctggaaccagcggtttatcagccagacctttttaggcgtaataatataatccctgaagtctatccggctccagagacctcctatatcctttaaatctttatccaatgcgtattttgaaaaaacgtatcctttatgcatatatattacctcatcaggaaagacacgctacaacactttactgtatcaatataccatacctgagatgttaaaagctactcatttttccaatttcatcctgctttgataaaaaatgtgtgtttctgcgctcacagggaatactttctgtagaaatcaaagaccccgctgcaagcaacggggtatcaaacttgcagcgctgcagagcagcggggtatttgaccctcgcggcagtcgccaaatatccatgcaagcatggctacttggctcgttgctcgcgggaataaaagagaaagaaggaattcccatgttctggaaaaaatatcgttatgaaatctacggcgtactttttaccgcagtggcgggtacgctgctccactttgtttatgaatggtcgggaagcgccgtcatcgtgggcctgtttgccccggtaaatgaatctgtgtgggagcatatcaagctgctgttctttcccggcctgctgttttctgtctgggattattttcatgcctcacgcaggccggcttccttcctcccctccaggacagccgggcttactgcaggcatggctgccattcccctgctgttttatgcctataccgcattgcttggcaccaatcatctggcactggatatcatggtcttcctgctgggaattctgctcgccttcctgataagcgccctgcttgagaaaaaaatcagtaccacagccacagcactgtccgggacaaaaacccgcgtgctgccgtttctcagcgccgttcttattattatttacctgctgctgttcttcctcttcaccttccggccgccgcagctgcccttattccgggatccggtttccggtcattttggcatttcctgaaatgagccggatgtgagccatattttgggggatttgccttttctgaagaaatgttaaaaagaccgggaacccgctgatattgcggattcccggtcttttcttcgaatgaagcacgggggattcgaacccccgacaacctgattaaaagtcaggtgctctaccgactgagctagtgctccataccattttcaattaagatgccctgtgttgtaaaaattattcattcccataaaagagaataaaaaaaagaaccattgaggaagattccttttcagcattctgcaactgggctagctggattcgaaccagcgaatgcaggagtcaaagtcctgtgccttaccgcttggcgatagcccaagaaggtggataaagggattcgaacccttggcctccagagccacaatctggcgcgctaaccaactgcgctatacccaccatatggattatgagaaatctcataaccactaacgtgctcgaagggattcgaacccccgacccacggcttagaaggccgttgctctatccagctgagctacgaacacatattacgggaacgcctggcaataatgcgacagggctattctgactaatgcattgcagattcatctgtagataaacctgccggaatacgcttgtccgctctgaaaagcaaaggacaatctggctgaaagccagctgcgtattcaaacggttcctttcccgcaagcgggtaattcgccgtaagcgggtgatgggaatcgaacccacgtatccagcttggaaggctggtgttctaccattgaactacacccgcatattggtgtctggattaaatcggggtgacaggattcgaacctgcgacctcctggtcccaaaccaggcgctctagccaagctgagccacaccccgttttctgctcacccttagccgtgacgcagaagttattatataataccttttgaccgatgtcaacactatttccaaatttttttccagtttttttacaaaattttttacatcggttttttacagataattcagatgatagtgggcctgtccgtccttatccagctccatcaggatataggaaggccttctgccctcctggcggggaaaggaaaggctgccgggattgatcgccgtgatatccttttccatatcaatgacaggcttatgcgtatggccgtacataacaatgtcaacgcctcttgcctgcgcctcttccttcagcatggaattccccatggatacataatagttgtgtccatgcgtaagccacaccttatattttcccagctggaattccttctcccggggcaaatccgtaaaaaaatcattattccctgacacgatttccaccgggcagcccgcatactccagataaaggtcttcgcttccctcagaatcaccgcagtgtatgagcatgtctattggcttcactcgtttgatcagctccagaaaacggtcatctctgcgatgagtatcgctgattatcagtaccctcatctaatggcaccttctttcctcattggtatccggatccttacaggatcccggcaagccgctccttcatcaggcgcagcgcattgcctctgtggctgatgctgttcttcgtctcgctgtccagctctgccgtagagcagccgtattcatccacataaaagatgggatcatagccaaaaccattggtgcctttctcttcccagccgatatatccttctatcactcctcttactacgattccctctgccgcctccggcagtacggccgcaatggcgcatacgaaccgggccgtccttttttctttggggacgccctccagcctgccgatgagattggcatttttaatgcggtaggaggtatcctcccccatgtatcttgcagagtaaatgccgggctccccattcaggtaatcaatttccaggccggaatcatccgccagcacaatgtcgtccctgcctgcacaggccgccaccgcccttgccttaatcagcgcattttcttcaaaggtggttccgtcctccacgatgtctatatcaatgcccgcttccttcatggacagcacctgcaggtccagatctcctaatatcatgcggatttcccgcatttttccttcatttcccgttgcaaaaataattcttctgctcatgcttcttaccttccatccggtaaattctgccgcctgggcggcttgggacccatatactggtaaaaataggtcttcatcattccattataaattttcctgttcttatccgctttcctgccgatgtcccgttccgcattctcataagcggtaatcagatacatggaccaggaatccagcgacgcataccgctccccaatctctttatagagggcgggaagcgctgacttttcctcaaggcgctcgccgtaaggcgggttggtaatgaggaagccgtacttcttcggatggctcagctgggataacgggcggcgctggaaatggatcagcttgtccactccagccagcttggcgttttccctggcaatggaaaccatggcatcatcaatatcgtagccctggatatcggtttcgatctgcagatccaccatttcccgcgcctcgtccacggcatcataccaattccgctttcccaccaccgagggccattcctcggcggtaaagctgcggttcatgccgggcgccatggaagccgccatcatggccgcctcaatgggaaaagtgccgcttccgcagaagggatccaccagaatccggtcccctctccagggggtgagcataatcagcgaggccgccaggttctccgcaatgggagccttggccgtcagcttccggtagccccgtttatgcagggattcccctgtggtatccagtcccacagtcacctcgtccttcatcaggaaaacgcggacagggaaaggcgcgccgtcctcttcaaaccagctcacatgatagacgcccttcagacgctccaccatggcctttttcataattgactggatatccgaggggctgaacagcttacttttcacgctggccgccttggctacccagaacttcccgtccgacgggataaattcctcccaggggaggctccttgttccctggaacagctcttcaaaggtttccgcatgaaagcttcccaccttaatcagaatacgctccgcgctgcgcaggaatacatttgcacggctcaccgcctcctcatctccgaaaaaggtgattctcccgtcttccaccagcgttacgtcatatcccaggtcaataatttctttttttaatactgcctccaggccaaagtggcatggggctatcagctcaaattttctcatagctatatattacgtttatttctccactgcgtcaatgaaattttgtcataagtggcgggaggacggaatgaatcattgcgcgtgggctgtccggggtgtgcggcatagggctttgaggggcggacggtgggagggaggggcgcgggggtttttcaggctgcagtcagaccgggcattgcgatgagccttggcaaaacattgtgtcaggaaagccttccacaatgtttaagtctcatctccatggtctgatatgcagcctgaaaaacccccgcgcccctccctcccaccgtccgcccctcaaagccctcgccgcatccccggacagcccacgcgcaatgattcattcctggggtagtggcaggccgctgataaaaaaggccgagaaataaataaaaaaccgggaagcggtgtgtggttacacagggcttcccggctttttgcagtttttaagctccgccgggcctttgcggttgggcttgggcggcggagattacttttcaggtgtactgattagtagttgttttctttgctgctgtttttgctgttgttattgttgttgctgttattgctgttattgttgttgttgctgttgctgctgttgttgtcgtggcagtcagagtagctgttcttgttctggttctgattcttctggctgttgctgctggaattctcagacttgttctgctggttctgcttttcactgttctggttgttctggttgtaatcattcttagacataattgtaaacctcctgattcatttttgttacaggagtagtatttgaaaaaatcatttttttatgcaaagaatttttttatttttaatttcgtcggatgagctttacgatgtagattaccaggatgatgggaatgaggtaggggagaatagcccacatgagggagcctaccacgctgataaccactaccactgccatgaggacaaggatggctatgagccagccgggcatgcgtaccttatggacggtgccggcacctctccgggtaaaggtttcttcattgaaggaatcctgggggcctgtgcctgatgcgcccctgaactgtgtctcgttggcttcgtgggcgtaggcgtctcctgcgcggtcagccgcatctatcagggttctggcaagaatcctgggatctcccagctcggaaaggatttccgcctcacttcttccttttgtttcttctgtataaaaatagctgtcataaaatctgatgttatcgtctacggatgcagccgccatattcccgttcagcgcacgccgcagagcgtccaggaattctgattttgtcatctgttttttctccttattttgctttctattcgtatcataccccacaaggacgtatattacaaggaaacggtttatgaaaaaaggattaaaaaaaactaaaaacagcctggccggtaatgggttgccggccaggctgtgtgtaaatttctgttttattcaacggttattttgacttcgcgggtgcttgtgccgattgctgcggatacacagccgcttacagaatcggtgtgtatctgtgcattttctgcttttacgccttccgcacagattccgtggaggatcacggtgaggcctttcatgtccccgtccgccttaaagctgtaaacgccgccttttctttctgcggtaatggcgcatacgtctgcaccctttacgtctaccatgcggcaggtacaggaagcgccgtcagccagctcatacaggtgaagggttgcgccgtccctgtagtcgtagtcgggcctgtcgtttaccgcgcctgtggcaagcagggtgttttcctttacatacaaaggcagggagaagtaatcgtactcgccttcgtagtaacggccgcctgtttttacctcgccggtaaagtaatccgtccatcttccttcaggcaggtagtactgtacctttttgtcctctctgagaaccggggctaccagcagtgcatcacccagcatatactgggtttccaggtatgccgccaccgggtcgcaggggtattcgaataccatggggcgcatcatgggcgtgccgtcttcatgggcttccacagcctttgcgtacaggtagggcatcagggtacatttcagtttggagaagaagcgtaccacatcgcttgcctcatcgtcaaacacccacggcactctgtagcttcctgaaccgtgaagcctgctgtgggaggaaagcagtccgaaggccgcccaccttttgtacaggtccggtgtcgcggtgctttcgaagccggaaatatcatggctccagaaggagaagccggacatggcaaaggaaaggccgccgcgcagtgtttccgccatggacggataattcgcggagcagtcgccgccccagtggacggggaactgctgtccgcccgccgccgcgcttcttgcaaagaggacggcttcgccttctcccttcacttccttcagcaggttgaatacgcactggttgtacaggtaggtatagtaattgtgcatgcttccctggtcgcttccgtcgaaccattccacatccacgggaactctttcgccaaaatctgttttaaagcagtcaacgcccatatccagcagggtcttcagcttatccgcataccatctgcaggcatccgggttggtgaaatcaaccagtcccatgccggcctgccagttgtcggtctgccatacgcctctgccgtccgctctttttacaagatagccgttctgggcgccttccttaaagaagggggttccctgtgcgatgtaggggttaatccatacgcagatcttcaggcctctgtcatgatatcttttcagcattccttcggtgtcggggaacactctcttgtcccaggtaaaatcacaccactggaattccttcatccagaagcagtcaaaatggaatacgcttaaggggatatccctgtcggccattccctggataaaggagctggttgtctcttcgtcatagttggtggtaaaggaggtggacagccaaaggccgaagctccatgccggaggaagcgcggggcgtccggtataggaggtataggcattgaggatttccttgggtgtggggccgtagataaagcagtatttcagttcttcaccgggtacggaaaagcccacatattccactttttcactggcaacctcaaaggaaacattgtctgtatggtccacataaatgccgtagcccttgttggtcatatagaaaggtacgctcttgtaggcaacctgggaagcggtgccgccgtcttcgttccaggtgtccactacctgtccgtttttcacaaaagaggtaaaacgttcgccgaagccgtatacgttttcgcctacctgcagggacagctcgttcaccatataaggctttccgttttccatcatataattgtccgcggggaacatggtggacggcgtcctgtcccagcgcgcatagccaaggttatggaagccgcatcttgtcagcaccttgccgtccgcctcgaaatggtagccccattccttcaggtttacgtgcacggaaacctttcctgcggtcattacggcttcttcttcgccgatttccacctgtacagcctgtgcctggggatgcttggggcagacaggctctcttttttcatagccctcgtgatgccaggctctcactgctatgatgttctccatgggcgcggtgaactccactgtgatcgtaggcatgttcagcgtggcgcccctggagctgatatagcccaccggagccagcacacgcatgccgccggggatttcctgaacctcataggcctgtgatgcgtaaagaatgttcgctttctcgctgcgcagccaatacccttccgtaaatttcatgttcttttcctctctttcttttttaaaaaaattatccgatattccctactgatctgccttcgtaaacttcgccttccaccacaaggatttcgggcacgctggttttggggtgttcaatgaggctgataagcttttcggcagcatagcctcccagcttctgcgtatcctgcttcagggtggtcagcttcggatccatgtgccgtccgatgcgcaggccgtcgtagcccgcgatggaaatgtcctccggaatgcgcaggcctttttcccgaagcatattcatgccgcccaggcaggcaaaatcatccggatacaggatgcaggtgggcgggcagggaagcgcgagaagctgctgcgtcgccgccgcggccccgtcggtatcccggtagcctgcctccagcacatattcatcaggcaccttaagccccagctcctccgccgtcttgtaaaaggaagacagacggctgcctgtaaccgaagagggatgcccgtggatataggcaatgcgcctgtgcccgcagctgtaaatataacgcagcagcgactgcatgcccttcacgttgtcgctcatcacggcaatcctgttgttgaaaatatggtcgatagtgaccaccggaatgtcgctggccaccagctgggccacctccgggtcctcaaaatccacacaggcgatgaccacgccgtcgaagcctctgtatcggacatgctccagataggtcattttcctgcgccgttcccggttccggttgacaaaggtgatgtcataatcatttttttccgctgtttccttgaagctttccagcacgctggcaaagtaatcatgggtcagcccgctgttcgcctcgtcggtaaacaggacgcccaggttatagcttctgttcgttttcagggccctggctacggaattggggaagtatcccatttcctttgccgtccggcggatcagctgcctggtctcttctccgatatcggtatggttattgagcgccttgctcacggacgccacggaaacgccgcaggcttctgcgatatctttcatggaaaccatatgccactctccttttgctgtaacagtgcaggcgggactggcttgtgcccttccgccgaaaccgtccagtcctggtcaaattgttgcccttccgccgttctacttaccttaatcgttttcgcaatactatcatatatcatttttacagggtaattcaatagcaactttttctttttccgtaaccttgcctatttttgttatatataaccaaaagaacctataaaaaatatacattttctccaagctgtttttctttttattcttccgctgccttcaccctctctttattccgtgggaacaggaacctgcatgaaggccggtaaaattttataattttaggttttccctcttgaaaatgcccggggtattctatataatccaaactacaggaggattttccactccgttacttaatcgttttcgtaaacatagcagggaagcagacggccatggaaataaggcgcggctgcaaaacaggattattatttgccggatgacggcggaatgagaggtcaagcatgaaatacggtttttttgatgacgccagctgtgaatatgtcatcaccacccccgaaacaccgctgccctggatcaattatctgggctgcaaggatttctttacactggtttccaatacctgcggaggctattccttttataaggacgccaagcttctgcgtctgacccggtatcgttacaataacgtgccttatgacaacaatggtcagtatttctatatcaaagacggcgcggatgtgtggaatccgggctggcagcctgtgaaacgcactctggattcctatgaatgccgccacggcctgggctacagccgttttaccggcagcctgaaccaggtcagcgcccaggtgctttcctttgttccgctgaatgattcctgcgaggtcagccgtctggtcctgaccaataacggaagcgcggcgaaagagctttccctgttttcttatgtggaatggtgtctgtggaatgcggacgatgacatgaagaatttccagcggaatttaagcatcggggaaatggagattgaaggctccaccatttatcataaaacagagtacagagagcgccgcaaccattatgcgctttattccgtcaactgtccggtggatggttttgacaccagcagggacgccttcctgggcgcctacagaagcccctccgatccggcggttgtcatgaacggcaaggcttccaattccgttgcccacggctggtcccccatcgcttcccaccagatcaatgtcaccctggctcccggcgaaagccgctcctttattttcgtcctggcttatgtggaaaacaaagaggaagaaaaatgggaagctcccggcatcatcaacaaaacaaaagctcacgagctgctttcccgttatcagtccgacgatgatgtggaaaaagcttatgcacagcttaaggaatactggcaggagctgctttccggatatcagatccagtccggctgtgaagaagtcaaccgcatggtaaatatctggaaccagtatcagtgtatggtaacctttaacatgtcacgcagcgcttcctattatgaatccggcatcggccgcggcatgggcttccgtgattcctgtcaggatctgctgggcttcgtgcatctgattcccgaacgggccagggaacgtatcctggatatcgcctccgcacagtttggcgacggcagcacctatcatcagtatcagccgcttaccaaaaaaggaaatgcggatatcggcggcggcttcaatgacgaccctctgtggctgattgcgggcaccagcgcttatattaaagaaaccggagatttttcaattctggatgaggtggtaacctttgacgacggcggcgaaggcaccctgtttgagcatctgacccgctccttccgttttaccgtaacccataagggtcctcacgggcttcccctcattggccgcgctgactggaacgactgtctgaacctgaactgcttctccgcacagcccggagaatccttccagaccttcggccccagcgaggggcctgttgcggaatctgttttcatcggcggcatgttcgtaaaatacggagaggaatacgctgcgatcgcagaaagccttggcaaaaaggagattgccgaggatgcccgcagggaggtagccgccatgtatgacacgcttcttcaggccggctgggacggagactggttcctgcgcgcttatgatgcttatggccagaaggtgggctcctccgaatgtgaagagggacagattttcatagagcctcagggcttctgcgtcctggcaggcgtgggtgttaaggaaggcaaggcgcagcaggcgcttgacagcgtaaaggagcggctggacagcaagtacggcatcatgcttctgcagcccgcctatacccgttatcatctggagcttggcgaaatcacctcctatccgccgggatacaaggaaaacgcaggtattttctgccataacaatccctgggtatccatcgcggaaaccgttatcggaagaggcggcagggcgtttgaaatatacaaaaagacctgtcccgcttatctggagggaatcagtgaaatccacaggaccgagccttactgctattcccagatgatcgccggccgcgacgcggcaaccttcggcgaagccaagaacagctggctcaccggcaccgctgcctggaccttcgtgaatatttcccagtatatcctgggtatccagcccagcctggacggtctttgcatcaatccctgcgtgcccgcagatttcggtgatttcaccatcaccagacgtttccgcggcgcagtttatcatattgaggtaaagaaccccggccatctggaaaaaggtgtttcctcccttatcgtagacggagaaactatcgaaggaaatgtggttcctttcgtagaaggcaagaaagagtatcatgtaactgcagttatggggtaatctgaggtatagcaagcagcacagcccgggggcaaggcccccgggctgtattgtttgtatattttatttttatcacttcattattatagctgtatccgtatttaatcccattcgtactgttccatataatcaatggtgcagcctgtatattcgatatatgcgttccccgcggcttttccggcctcgtcaatcgtctttttcaggaaggcttcatccagcttctgtccacgatccgcattgtccacccgtttttgtacctctgaaaccacatcctccaggaacttatccctttcggcaacggtgagtttatccgcatccaggatatggtaggtaaaggaataatagccttccgccagctccaccacaacttcatcgccgtatacatcctcctttcgggaagcgttgatggacacggcatattcgggatcgatttgtttcctggcatacagtgacctttctgcagcataatattcatccatggagttgctgaccgtggtctgcaggaatttcacatcggcatccgtcttattggtaatccggctctgctcttcctccagctccatcaaaaccatttcatataaataagaaatatccataatctcgtcatattccgataatgccgcatgggtcttccggttgaattcagccagggacatcttttcatagccgtccggtttcagggctttcagcacaaggtcgtatttttcctgaggcgtatacttttcttcttcgtcctcctcatcctcccagtcctttgaatcgtcccactcatcatatctgctgtcccaataatagcagatttccttctgtccgccccaggccaggccgccctccagcttctccaggatacggcccagctcgtcatccagcgttttttccatgtttttttcatccttcagcttcccggcatcctgtttttccagaaacgtctgcatttccttatcgatgttttccagcaggctgtcgcgttgttccactgttatggctgatgtatccgggatttcataatcatatgaaatatcacaataggctccggtaagcagcatctcatccccaaaaacatctccataggtttcacaatatgcttcccctgaatgccagggatttttttcctgctgacacgtttcataatgcctgcggtcacattcgtcccatgtattggacagcgttccatggacaaagccataaagggcgtcctcttcctcaagggtggtaaaaatgcgctgaaagctttcctccgtcctgtgatatgcctcctcgtcatcccagtccatgaccatgcggttgaactcctccacactcatttgtccatagtccgccgtatggaaggactgtatcagcgcatagtctgtttccgtatatttatatttgccgcttctaaagaaaaaactgttccggcccggacggtagcctgtgctgcccgtccaggtatccggcgcttccccgctcccggcctgttccgtctccggctgcgcggtttgttcctctgtctgtcctgttgcactgctgtccgccgcgctatcagcctgcgcggtttgttccggatctatctccagttttccggaggtccccggcgaggatgcacaggcggtcagcagtatggaaagcacaacggccagggcagccgcgcccgctgcttttctgttcttcatgtttgctcctatctgtgcgctttagcgcaccttttattcagggagctgaaagcgtctttctttcagctttgctcctatccgtgcgctttagcgcacattttattctttctccagataatttacttcgcagcccgtaaaaccgattttttcattggcaagctcttttcccgccgtgtcaagaagggcctggaattcctgttccgtatgcccctgctcctgttcctcttccagcagagtctgtgccgcctgcatcacctgctgcaggaaagcatcccgttctcctacggtcaggctgtcctgatccagaatccggtaggtgaaggaatattccagccacagccctcctgccggatacgcatcaccaaaaacgtcctccgtcctgacagcctccgccgttgctgaaaactgaggatccatctgtttcccggaatatacctcgttcaggcgggtctggtattcctccagcgaagcaggtatcgtattacgcagatatcccgcattcggatctgtattttctatataagaagccacctgttcaaacagataatacaggccgtccctccctttttcatcctccgtaagcgccttgttaataaagctgttgaatgcggcgatggacatttcctcatagccctccggctttaatgccttcatgagcttatcgtactcctcctgtgtatagccttctttttccatcggataatcccggtcgtatctgtcttcccagccatactcctggtataaggtatttttcagcgtatgactgttttcttcggcctccgctaccggctccttatccatattctcgattctgacagccgggcgatttgaaccaattccggcggtggcaaaaatactgataaccgccgccacaaccacgagggccgccgcaatgcttcctttcgtcagctttttcgccttcatgatggcttcaatccgttccttcagggcacttttgctgaagctggaagccagcggggacagacggttcctcttctcctccatgccaaggagcgccagcgcgtaggagggacaggcctgcattccgtactgcctgattaccgcctcgtcacaggccagctccaaatccctgttggcaagaatatacatggcccatacgagcgggttaaaccagtgtatacacagcgccgccgccagaagccatttggtaaacgcatcaaatcttcggatatgggacatttcatgagacagaataaaagccgccgtttcctcatccgcccagtccatatccgcaggaaccagaagtaccggccacaaaaaaccataagtcagcggtgattcaattctgtctgaataccgtatctgtaccggccgcctgatgcggttttcttccagccaggccttggcgaagggctgttccacaggcagcgacgcactgtaaaccctgcggccccgcaggtgtcccacaaggaagaaagctgccagcaataccgccccggcaatccagatcccatgccagacggacaaatgtgacgccattaccgccgcggcccccgaagcttcagacgccgcctggcccgcagcctccgacaaaagcagccccgggcggactgccagccgttccagctgtcccgacggcctgtaaacgcttataggcgacggaagccttaccggaatcatcaggcagaaaaatgcagcggcccaaagccacagaaaagcctttttcggcagccggttgactgccagagcgcggacgatgacgattaccgctatcaataccgccccgcttacgctcattttgaccaatacatccatgacgtcacctccacttttcaatcatttccttcatccggctgatttcctcagaggaaagcttcctgttccccaaaagggaggctaccaggagatccgccgaaccgtcgtaattccgctggatcagttcttccgtttcctgttcccttacgctttccctgctgagaagcgcatggcagataaatcccggttctttacgggcaaccgctcctttttccacacatttcctgatgatggtataggtggtggtcttgctccagccaaccttcttattcagacgctccgcgatctccttggcagaaagatctccctcgtcccagagacattccattacccggcgttccgaatcaaataattttccgttcatatccactcctgtctgcgcatacttccgcgctgtcattaatttttgcaagcggagtaaaaatgatatgcctttcattatctttcattttactccagtagaatatatttttattctactccagtaaaatgagtgtgtcaagaagaaacttggtgggagcaaataaatgattttagtgataaataaaaaaatggttgcggcggcagacaagccaggcatttcaggaggatatttttcatccgagaaactacagaaacatttttccagtacagtactgggagtgttccggcaacaaaaaagggaagccggaaatcttcggcctccctatccatatattttttgaatatttggactgtttttttattgaaaggtgattttctgcgaacaacagctgcctccgcgcaaaaacgtttccaacaattctgctttattaaagcgcttattcctccggttcactgtagctcatcttcacatgaatatcctggttgtagttaccgaatgatttcccgaatatcgtcaggccgcccacatgctccgaagcttcgtccacggcgaagcggaggcggatattgctcctatagtccaggtgaaaacggctgatatcaactttggaaatctgaatcccgtcaatgaaggtccctttatcattaatgacaaggaacttaagcaggccgtactggttccagttgggataccaccagtccggcgtgaatacgcctcttacatccccgaaatcccccggggaagtccattttcccagcagtacgtcattcaggtaaaaactgatatccgacggccatacattattcacccccggagcctcgcttcccagctccagggataccgatatctgattaattttatttccgaaggggataaaattgggtatcacatattccacatatcctttggtaaaccacagaatatctgcgttatatctgtccggatgggcaaaatacctgatatcgtccacttctccaatcaacgctgacgccgatgccatcccgcaggtgggatacacctcaaagccggtaaaatgccccaccttcaaatccgtatcatatacattcttattctgtgcggggctgtccacctctatcagaattttatccagggctactgagcacttcttctggttgccatgccctgccgactcgctggttacggtaataatgccgcattcctccagcttcctcacatggctggtcagcgccccgttggtaatcttaagcctggaggccagctcattcatattcatatccctgttttcaagaaggattctgatgatttctatacggatgtcggagccaagggccttaaaaatatccagcccctcctccagtgatttgatatgaagcattctctacccccgcggaaattccttttttcttccgccgcgtcaagcctgtctggcacagcttccttttgttttgcagcccccgtaaccgttcggactgttacatctcaccacttgtcatagggacagctgttcacagcaatcacggcccgcagctccacaaagcagccgcaggccctgcacatcccctgaagtagcatgtcacactgcttgcagacggcgagcctttcttcataaagcacgccgtccgctttgatatcctcatccaggttggcaatgtaatcatgcaggttttgaaaatatgcatcctgatccatctcccggagaagacatttcaggcaatgctttttaccgtctgtttccatagccgctcctgcctgctttcctttgcttaacggatgcgaagcagtaccacgcttgatgcgggaacgctgaatttcacgccgttttccgtaatctcataattggtgaattccacttccttcacgcgatccggttcttcaaaggtgttataggcatccattttttccgtaaggatgctggcagtaacactggagggcttcaattctgcaaagcttacctccacctcgctctcctccgtcacggaaaggttattcagagtcaggttgacggtcccgtctgcggatacggatacggattcatgaagggaaggaacgcggatttcatcctctcccacttccttcagcccttcaatatagctttccaccagatccgcatcctgatggtatttatacatatggaatacatgataggtgggagtcttgagcattttagggccttccgtcaggattacggactgcagtacgttcaccatctgggcgatgcaggccatctttaccctgtcgcagtgcttgttgaaaatatccagcgtgattccggcaaccagtgcatcacgcatggtgttctgctgatataaaaagcccggatttgtgcccggctccacatcgaaccagtcgccccattcgtccacgatcaggccgatttttttctccggatcatactgatccataatcgcgccgtgacgggtaaccagttcttccatatagagggccttagccatggttttaaaccaggttttctcgtcaaactttgttgcgcttcccttttcatcccatccgtccggatgtacgtaataatgcagggaaagaccgttcatgagacgggacggtgtgggcgcacaggtatccagcaccttttcggtccagtgataatcagccacgttagggccgccgcacaccttataaataggggcgtcctgatgatactgacgcacataggtctgatatctgcggtaaagattcgcgtaatactctggcgtcatgttaccgccgcagccccagttttcattgcctacgccgaagaaatcaatcttccagggcttctcatggccgttctgctttctcagatccgccataggggatacgccttcaaaagtaatatactccacccattcggacatttcctgaaccgtaccgctgcccacattgccgtttacataggttttgcagcccagctgctcacacagttcaaaaaactcatgggttccgaagctgttgtcttcaacgacgccgccccagtgggtgttgatcatctttttccgtttttctttaggcccaatgccatccttccaatggtattcatcagcaaagcagccgcccggccagcgcagtaccggaatctgcatttccttcagcgcttccaccacgtccgttctcatgccgttcacattgggaatatccgagttttcccctacatagaggccttcataaatacagcgtcccagatgctcgctgaaatgtccgtaaatttccggattgatgtgtccctgtttcttcttttcgttgatgaaaatttttgccattgccttgttctcccttttctttttattcccgtgagcaacgagccaagtatccatgcttgcatggatatttggcgactgccgcgagggtcaaataccccgttgcttgcagcggggtatttgattttacacgtgtagcgtgtccggctgcttttcccgggctttaccgccgccggcgccggaacagctgccccgcagtttgtaactggtcaggcagatctgaattgccgcagtttgtttagcggtaagaaaataccggttttccttcttcactccactgtaccttcataagcatggtatgacggttgggattgtacagcggatcgccttcaatgacagcttccttcctggcatgataaacgcagatatcgccgccttcttcatccgtggtaaaggaattatgccccggcccgtaaatttcaagggcttcatcggaagccagcaccggataccgttcctttgtccaggaagccggatcaaggagatccgcgtcctcagaagcgctcagcatgcccatgcaatagcaggctccggtagcgctggcggaataggtgagaaaaatcctgccgccgcgtttgattacggccggtccctcattcacccagaaatctactctctcccagtcatagtccggtgtggtaagcagcacctgcacggtttccagacggttcggcgcagccatacgcgctatgtacagattggaaatcattttgcccacgcccactttttccgcccagacataataatggcttcctttgcattcaaataccgtggcatccagtgaaaaggccctgaaagaaaattcatcctccggcgcgcactgcattttccctagctccttccaggtaccggttattggatccgcatccgcacattccagcacataaggacggattgcccagatattttccgcttcgcccgccgcaaaatacaaataccattttccttccagataatgcagctccggcgcccagatgtggtacgacatgatgccgctttcatgcttcttccagacagtgatttcttcagcgtccgcaagcccggccagactgtccgccctgcgcaggatgattctgtcataagcaggcacggatgcggtaaaataatacataccgtccgtatggcggcagatatacgggtccgcccgctgcgcaatccagggttcattgaatttaagctgtttctccattttttgctcccatccgtgcgctctggcgcacatgactaaaattatacaggaatcagtctgcattcatgatgcataatttagattttattaaaataattgagttctctctaaattatataattaatgcctgcattttgcaagtcagaaaataaataagtatagaaaaaaagtaacagtttggccgaaggctgaattgttacaaaaaagcagcctccacccatcgatggaagccgcccgttttttcaatcggttttggcagtatagctccgccgtatttcatatcaggaactctgtaaggccttcatttttttcatccgcagataatagctggttaccaggattacgtccgccccgatccaggcaagaatttccgcataaaagataccctcctcccccaggaacacaggaagcagaattgccgtgccggttctcataacaaactccgcaatgccggaggccatgggaagcagcgtatctcccatcccctgcagggccgaacgggtaacatgcaggacataaaggataggaaggaaaacactcatgatagccaggtaatgatatgcgatattcatcgtcaccgccacatcctcaggcgaaccggaaatgaaacagcccagaaccgccttgccgaaaaggagcatggccgccgcaatcacggcagacgtaaccatggccacgatcagcgcggagcgcattcccttgctgatacggtctattttttttgcgcccagattctgtcccacataggtaaccatggcataaccgtaagaggtggccgccacctccagaatgccgtaaagcttattggttgccgtaaagccggcaataaataatacgccgaagccattgactacgaactggacaatcataccgcccaccgcaataatcgcattctggaatgccatgggaagccccagcttcatcaggtacaggcagagagtcccttccattttgaagtcctccctggtaaaagccagcacctccacccggctgatggcaagaaggcagaaaattccggaacacagctgtgcgattaccgtcgctgccgccgcaccctgaatcccccagtgaaagcccagtacaaacaaaagatccagcgccacgtttatcaccgcggccacaatcatggcatacagaggagtcctgccatcacccagcgcacgcaggatggacgccagaatattataagccatcaccaccggaatcccggcaaacatgatgcgcagatatttcagcgaatcatcaatgatcgtatccggcgtctgcagaagctccaggaccggcctggccagaaactcactcgctacaagcagcagcagtgaggtaagaattgccagcaggatggaattggccaccgtcttgcgcagcctccggtaatcccctgcaccgaattcgtgggacatttttatggaaaagccctgggtaaagccctgaatggttcccagaatcatccagttcagccagtccgccgcccccagtgccgccagcgccccgacccccagcgcctgtcccaccaccatggtatccaccacggtatacagctgttggaaaacattccctatcatcaacggaagggaaaaagccaggataagccttaagggctttccctccgtcatattctgaacacgtgctgccatttaaaaacctcgtctttctgatgtgttatctatgcagcgccccataggatacaggcccttcccccacacggctgcggtatcttcagctaccgtaagctgcaaagagaacccgcactgccgtcacgcttccgggcaaaaggaaacctgcaccgcctttacaaaggcaaaatgcaagcatataatcacactataacagaaattataaaaaaacaaaagaggctgattatgattcccgaaaatacaaaaaatgatttttccaaaggcagcgtagttaaaaatatcgtctcactggcacttccgatgaccctcgcccagctgattaacattctttataatatcgttgaccgtatgtatatcggacgcatccctgagcatgccacgctttcccttaccggactggggctttccatgcccatcatcacggtagtcatcgcttttgccaatctgttcgggatgggcggcgcgccgctttgctccatcgcaagaggcaagggggatactaagggcgcggaaaaaattgtaggcaacgcctttaccatgcttttgtgcaccgggctgctgctcaccatcatagggctgctgtttaaaaaacctcttttatacgccttcggcgccagtgacgctacgtttccctttgcagacagctacctttccatttacctgctgggcagcgtctttgtcaccgtaagtctgggaatgaacagctatatcaatgcccagggctttgcccgggtgggtatggtcaccacgctcatcggcgctgtgctgaatataattctcgatcccttttttatttttacactgggtatgggaattcagggggcggcaatcgccaccgttatctcacagttcgcttccgcagcctggaccgtgcgattccttaccagcccgaaggccatcctgcgcatccgtgtatcctgtatgcgtccctgcggcaaaaccatccgcgatatcaccactctggggctgtccaatttcatgatggcaatcaccaacagtattgtgcaggtggtatgtaacgccacgctctccatctacggcggggatctttatgtaggcgtcatgacggttatcaactccatccgcgaaatcgtctccatgcctgtgtccggcgttacaaacggctcccagcctgttatcagctttaactacggcgcggataaatatgatcggataaaaacggccatccgtttcatggccgtcagctgtatcgtttatactaccgcaatctggggtatcctgcacctgttccccgtcttttttatccatattttcaatacccaggcggatttggtggaagcggcagtcccctccatgcagatttattattttggtttttttatgatgtccctgcaattttcaggccagactgtatttcaggcgctggggaaggcgaaatatgctattttcttctctgtgctgcgtaaggttgtcattgtcgccccgctaaccatcctgctgcccagatggattacccctgccgtaaatggcgtattcctggcggaacccatctccaactttatcggcggcactgcctgttttgttactatgctgattgttgtccggaaagaacttaaaatggcggaacagaaagaataatattttatcccattactgaaaaaaatattaagaagcatccgttggttataaccagggatttactcaggcaatggaaaataaacataatccagccctgatttttcaactatttcttcaaattcattaatggcttcctccacattttttgtcacggtaaaaaatcctctggtcttatgggaataatgcaaattagaaaaaatctgattattctttgcatactctgcttcgatatcaaaacttggcagtaatatataagtatctaaggaaatgtcagtgctccctatatgaaccgatgatgtattatccaggaagcctatcactttaagttctaaaggatagcctgcataaagcacggtaattacgtcaccaatctgatacagttccagataatcatatcccaaaagaacaggaattctatttccattgtacaaaaagtctgatgcagaaaaggcgtttccacgaacaacatgggcctgcaaggataaatcctccgtaaaggccttctcgctgattaaggctccctttatgttggtaatatgtatgatacttccatcttctgcttttgccctctgatttatgaatgattctagttcttcttcagataaagacccgtaaccgggaataaaagaatccccatttggataaagtcccacatattgcagcagtacgtcatgtgcttcaatatatcggaaattatccgcgctgttaaattcttcaagcagtttgacatattgtgcgaatgtattttcacgatgcagtatcgtcctaaacctttcatgtcccggctggccataattatctttaactttataattcagacaggtgctgtaatcaaaattataattgtcaacaggttcgttaatttttcttttagcataatatgtaactgtaagcatacaaaataaaaataataaaaaggcagtaaccgcaataatcattttacttttcataattctcccgttttttccttggcatttacaggaattgatatagtgccgcataaacagattaaagttaaggctaatgtaaacacttttctttttttatacatacttttaccctagaattaattataaatgcattcttttataccaaccaattaaacagactacttacttgtcttctcttttttttacattatcatatatatttgtaccagtcaatatatgattacatgtttatagtctttttttaattttcgttccggttcgatataaagcaaaccaatgacacccgatacggagaacttttataattcaaatactataaatttttacacagctttatcgaaaatagctacacttactatcggatagcacaaaataccagaaccgttacaatgccctctttacgcgcgcatggcatcagagtgaacaactgagacttgtttttccgcagataaaattggggccgaaaaaacaattacgcgaagaactgaatactggttgacatatttaaattttgtctatatagttaatatagattacaaaaatgtagtcaaaatatcctatgtataatacaattgattgttttgaaaggacgaaaaatatgaatttactcagtttaagccctgctgaagcagaaatcatggaattattatgggagggaggggaaaaaacaaaccgagagctgctgttttacctgaatacagacggacgcgactggaagcgtcagactcttaatacattgctgacacggcttattgcaaagaatctggtgaaaaaaaaacggtcacaaatttatggctgaaatttcaaaacaggagtacaacagtgcccaggcacaaagtgttttggaaacaatgtacaatggttctcttgccaattttatcatgacgcttaccggaggaaatcaattatcagaagaagaagcagcgactctgcgaaaacttcttaatgaaaaagacggtgagaaggagtgaagaccattttcattatgtcactgacgggcagtataatagtaatagccattcggttactaaaaccatttataaacaagtatggcttaattgaatggcaggcattgttgttaaagctttctgccgtcttttttatgattccgatgccatttatgaaatggttctatcagggactgcggcgtttgtttattccagagagttctggccaatccgatgctattctaattacaagaaagcatgccgcaatactgttatccgatacaaaatgggtggtaaatatcccggggaaaatatacatggaaattgtggttatctggttaatagtggctttctttatcctggttaaatatattttgcaatacaaaaaatacaaaaccctgatttttattgaattcccgagagtatcagataaggaactgtttgcaatgttaggcagtttacaaaaagaaacaggaataaacaccaaaatccagttatatatagacccttttagaaaagaagccttttctatgggcattcttcatcctctgatagtgctgcctgcaaatatggataaagataaattgagattgattcttctccatgagctcatacatataaaaaacaaagatttactggtaaagggagcggcattgctaattctatgcattcattggtttaacccgcttgcctatttgctttttaaaatgataaatgaatcaaacgaaatttgctgtgacaagaaagcttcgaaaactttaagcagggaagaatgccggttatattgcgagttaattattgaaatggcgacaagtaaacagaagcaaattttatttatttcaccgttaaaaggaggttacaaggaaatgaaaagaagactcacctatctgatgaatgaaaattatgcacccaaaatagtgaaatatctaacttgttttatttctatatttcttgttgtcagctgttcaatgactgcattagcttatggagaaccgattgaggtgctgaaaatggtcggccaggaagagaatttggaagagcaatttgatggctttacgcatttagatattgcatttgcagaaaatggtgttagtttaccgtttgaactaaatgaaaagattttgtttcaagagcaatttatagatgaaaacggcaacatatctgaggcggataaaactgtcaggaactcctgttcccactctgtcactgttgacggaacttatcaaaaacatgaattacataatgacgggagctgtaagattaaaaattataatgcaaagcgatgcaaggaatgcggaactttgattattggaaattttattagcgaagcctactatccgaaatgtattcattaacttatcgtcagccatactgttattaataaagaaaaagctattgtggatccggaaagtctaatccttgcaatagctttttccttttcccgttctctccccgggttaaacgcatccgcctacctgtccacttccggcttctcccggtaggtcttcataaactgatccagatatcccctgctcagccttttgcagatgtaatggccctcttccttttctatgatccccgactgcttcagataattgataatcgcattcaggcacataatattaccgaaggatgaggtaaggatgatattcagatcctctgattcaatccggatcaggttacggaaggaggcataaaaataatccttcatctgctgatactccaggggccggaaaggaatgaatacaaaatccggggtaatggaatacagatgcctcgtcacctcgttaaaaacactttccccttccctgttcgtatcgatctccattaaaacaaaagtgttcagccgggaataataagtcagtatcattttgatgagatcacagatatataaaagcagggaatgctccagccccatgatattctcaaagcagagcacggttcttttcctggtgcaaagcttaagcaccgtgtattttatttcatccgtaagctgggtctcatccgcagagttcatggaaatcagggggatgctgccctccagctccggagtggtgagtatgtaggcgttaatgtcattggcaaatgaccttatcccgtagttcccctctcccaaaagggaaatgttgatgacattctcacactgctgacagaagttctggatgacccaggactttcccaaacctctgtttcctgaaaggattgccgccgtagactttctcgcttccttatagcattccgtcagcttggtcagttctttggtattcaaatggattggcatgatgtcataactccgcttcttaacattttcagctgctccctcagtttatggtaaatacgtatttcctctgaaaaccagaaaaaccagccgattcatatattattgtcccatgggtatgcaagcgtgtcaagaaaaattatttacggtattttgtacgcagtacgatattttccatcaataaaacgcgcaatatctgccgtaatattccagacaatgaaatattgtaaccgtacagataaccagcctgtatcgttatactttttttatttttattttttcttgtaaccctattgacattctcttccacatcggttaaaatataaaacgttgccggagttaattggtaacaaaatgtgcgcgtagctcagctggatagagcgtctgactacggatcagaaggccgggagttcgaatcttctcgcgcacgctgtttaaggctgcagaatttttattctgcagtttttttattgctgcaaatatggaaattaacctggctgatatcctgcatccatccgcctgatttcaaaagggccttccatagccgccggcagttaccgaacggctcggaaggaccatttttatttattttgcttcttccctattgtaaatcctatgcgcttcttcctttccatccttccaggagatatccacacattttcttcctttaatgcaaagccccttcacatagccatccttaaactgcctgggcagcgccggaagcagcttcacctctccgcccctgtcctgcaccagcatgttggcaatggcagccgtgccgccgaaattcccgtcaatctggaacggcggatgggcgtcccagagattgggataggtggatctggtgagcagggtgcgcaggtaggcataggcattttccgaatcctccaaaatggcaaatacgttggtgatccaggcacagctccagccggtatgcccgcctccgttttccagccggtgcttcagggatatcctgcaggcctccgtcagcttttcatttcctgcaaacagctctgaagggaacaatccatataaatgggaaatatgacggtggccgggttccggttcttcatactcctcatgccattccagaagctgtccgaagcttcctgtccgaaagggggccaggcggggcagcttttccctgatttcatccagcagggaatcctgtgtgcccagaatttcacagattttcatgtagttcccaaatacctcccgcacaatggccatgtccatggaggaagcataggttacgcttgtggtctgtccgtcaggaaggcggaactggttttcaggagaggtggagggacaggtcacgtattcgccctgatattccaccagccagtcattcaggaacagcgcggcctcccggataatcggtgccgccacctccttcagatagcgttcatcctggctgtattcataagcgcggaacagctcctgggtcagccatgcgccgcccatgggccagtatgcccagttcacgcagccgtcgccgccctctgtctgtccgggaagcagtcccaccggattggtattcccccagaaatcgatgttatgatgcgccacaaaacccctgcagtgatagttaacggaagccgttttctttccttcctcacagattttttccataaagcggaaataaggctccgcacactctcccaggttgcagctctgggcatgccagtaattcatctgggtattgatattgatcgtccagttgctgctccagggagcgcgcagctcccagctccagattccctgcaggttggcgggaaggcttccttctctggaggaagcgatgagcagataccttccgtactggaaaaacaggctgtaaaggccattgtcctcttctcccttttttaacagctccaggcgttcatccgtgggaagcgccttctgctctcccagatacagctccaccctgccgtaaagcgcttcataatcccggatatgctccgccttcaaagagtcgtaggaagcattttcggataaggccggctcctttaccgccgatagaatgaggacacagacggatgcgccgcttacacggatcctgtcccctgtattttccacaaggccgtcgcattccagaatgcggacagctgccgtaaacgctttccccctggttccctgaaccaccgaatcctcacggaggggaatataggaagggtccacatgctccggacatcttcctgcgatttcaagtccccccttctttgcctcgcaggtgtgctccagttcggaggcaaaggacatggtaaaatccatcgccgcccgatccgccttcagacggatgcagatggcccttgccggatagctggcaaaatactctctttcatagtgcgtgccgcaacagctataggctacccgggcacatgcatgatcaatatccagctctctgcggtaatccgctgccgcagtctccccttcataggaaaaccggaggctgaggctgcccaggggcaggtaggattcattgaattcccccagcatgcttttctggatcagacgttccgcttctttattttttcctgcaaaaataaggcggcgcacctcctccagctgcgcggctgctcccgggttgtttttgtccttataatagcccgaccacaggctttcttcatttaatcccaggatttcctcgtcggtcccgcccttaatcatggcgcccaggctcccgtttccaatgggcaggctttcctcccatttttctgcgctccttacataccacagcttcatttcattcatcgtccgtactcctttttattcccgcaggtatccggccaggcgcaggcttgtctgccttttgcggccgcagcgggtctttggctattttaaaatttccatcagctcttccctggtaaaggatgcccttcccatttcctccccgcccagaatgctgtccgccagcgccttctttttttcctgaagggctgttattttttcttctatggtgccctttgcaatcagcttataaacggtcaccacgttcctctggccgatacggtgcgcccggtcggtggcctggttctgcacagccacgttccaccagggatcaaaatgaatcacgatgtccgccgccgtcaggttcaggcctgtccctcctgccttaagggaaatacagaaaacctgcgtgtcatccctgttgaagctctccaccagctccatacgccttaccttgggcgtgctgccgtccagcgtgtaatatgaaattttttctttggcaagcgcgctcttcagccgttccagcatggaggtgaactgggagaaaagcagcaccttatgcccgccctccgccgcattgcgtatcaattccatacagagccttgttttggcgctgtccccttcatagccgtcaaacaaaagccccggatcgcagcagatctgccgcagcttggtaagctccgaaagcacctgtatctgcgttcccgcaaattcctgatccgtctgtttggtgagcacagctatcagacgctgcacatgggcgtcatacaggctgctctgctcgccctccatcacggccatcatgggcttttcgatcttatccggaaggtcggtgagcacatcctttttcagcctgcgcagcacaaacggacggatcattttatggaggcgcaccgcggtttcctcatcctccctggatacgattggcgtttccatctcctcccggaaacggctgtaggaaaacaggaagcccggcatcaggtaatcaaaaatgctccacagctcactgagccggttttccaccggcgttcccgtcagcgcaagccggaagcctgcggggacctgcttcacagccctggccgcctgggtggaatggttcttgataaactgcgcctcgtcgattacctcgcaggcgaaatccatgccggtataaatatcaatatcccggcgcaacagctcataggaggtgattatcacaccttttttctcccgtgccgcctgctccagaagctgctttctctccccggccccgcctgccgccgcataaaccggaagcacaggggcaaagcgttccacttcgcttttccagttgaagaccagggaagccggacacacgatcagccagggccgtcccggattttccccgctctccttccactccgataaaagaaaagcaattacctgcagtgtttttcccagccccatatcgtccgccagaatcccgccgaagccgttggccttcagggttttgatccacagaaagccctgcttctgatatccgcgcagaataccgtccagctccggaggcacctcaaaatcattgtcctccacggtcttcatattccgcaccagcgcgcggaagcttttccccttctgcagggacaggccgctgtcttccttcaggctgccgtcaagatacatggcccggtagcggggcaggctgactacgccgtcctccatggcagaatcggctatcatcagctcctgcttcagctgtgccagcgtgcggatcccttcatctcccaaatccacaaagctgccgtttttcaaccggtagtatttctttttcctgtcataacgggacagaatggaaatcagctgatccatgggcatttcttccgactgcagcgtaagctccagcaaatcccccgctatggatacgcccacgctcacatgcggcgcgggcagcacgcgcatggctctgactgcatcggaaatatatacctcgcacagctcctgcagcctggggatcccttcctgcaaaaagagaaaaagccgctcctcatccgaagagagcaccatctgacgcttgccgggatcataggcgttgaaaaattcccccaccaggcccttcatcagcatttcccgccgcgcatcccgccgctcggtcagatccaggctgtcaaacaggttatatttttcctccccgtacaccgcgtaaagctcacaggtcagcagatccctctggggcgcgtccaggtagatttcaaaggacgcctcctccggcaggtattcctccggtgaaaaattcctcatttccacctcaaaatgctcctgcaggaccggcagcatgtccctggcaaaggccggaagctccgtgcctgccacatacaggccgcttttgccgaagctgtccatataaatcaggaactccctgatttcctctatccgttcccgatccgttttccatatggttccctcgtcgaaaaagtacccataccgcttcccggtcaccagctgcatccgctgcagctttatggaaataccgtaagaatcgccgcttatttccaaacgccgcaccggctccccttcccggaacgaccattccctggcaatcccatccgccgtctctcccataagcggccctgcgccagcggcatccaggaaatcatcgatcagttccggagtgacattcagatcccgtttatatacggtggaaagataattgcccatatagctgctgcccttgagcagcgaatactggagaaaacgtaccaacggcctgctctccggggtaaaggcctccggatggtggtagaattccagctccttaccataaaatacctgttcatttctggcaacagcattcacgaaatcaccgatatttttcagcacatacatccgggtgcatccgatcttaaattccaccctcatgttttccgcaggcagataaaaatacggctccagccgcaccctgcccagaatatccggctgcatcagattcaccttgtcgcggtaaacatactggttgagaatcccgtcaaagccataggttgaggttctgggacggggcgccgcaggaaccgcagaaagcgcgcgcggccgcattctctgttcctttctttcttctatataatcgagaagcacagccacacaatgcttgcaaagtccgctgtagctgtaaaacgccgggcattcacagtcgctttccagaacttctctgtaatcctcatctatttttaatttaacatcgtacagatttccatggcttccgctgacgctggcctccatggataccacctcaaagccgtcctccagctcctttgtccagtgcagattttgcactgctccccgctgattcagatcatctcccttgagaaacgtaactttatggcattcgcggcggatatcggttctgctcagcatggcttgcttcctttcgtgattttctcctttgtcagggacggattaatcataccattttcatgcacaaacatccaccagaaaaatatccttgttggcataaaatatgacatactgttgtcaggtttaccatgctataattcaaatcataaatacaccggccgcagccgcttgatggtatgcagaacagacggctgtgtataacatttctttagaactgtaaaaatacaatggggccaacctggaggatatcacatgaatatcagaaaagaactggaaaacgccttgggggcggcgcagcatatacagctgaatgatttggaacttgaccctctgaaaatcagggcaatcctgataaatgaagcggttccctgtgatccttcccaggatttctacggccggcaggatgccgcctacctttcaacaacgataccattgtttcaaaaggcaggttttaaggtccagagtatccaggatatcctgcagttgggaatctacattaccaacgcggtcaaaacaccgaaaaccgagtatgcaattgcccgaagcaccatagaagacagcctgccctatctggaaaaggaactggccctgtttcccaataaaaaagtgattatgcttatgggcgatgtggccaaaaaagcctttaatatgataacaaaaaaagagtcaaagaaaaatgcggttcctgccgtttccacatataagctgcgcagcagtgaaatatattataacggcatccgcatcatgccgtcttatattatgacgggcggaaatattctgattgaaaagtcaaaggtggaaatggcatcagaggatcttgccattatggggcggattattgcgcagtaaaaaatccctggataaccggcaggtaacggttacccagggaaagagataattccaataatcccatttcccgaacagcctgtggctgtccagttttccttattattgcgaatgcctgcagtaggaccaggacgccgccgcaagaaataccggaatttcaatcagtgatgccgctgctatcacataaggggaccatacgctgaaatttcccaggtggaggaaattgaaatccgtcatttctcccgcaaatccccccagtatacttacgccgccggagggcagaaggcatctcagccaggatacagcgtttccggaggatgccatataaaggatgatgggcgccaggcaaaacagcagggccagggaaagggctgtgaccgtatttttacagcgtgaggaaagaaacagcgtaaagctgatggtggcaagcaggctggcccatcccgcggccgtcaccgccagctgcagctgcccgatgttcatgctgcccaggcttacagaggaaaagataagctgtatggaggttttcagcatatcccagccataaaagctgttggacagcaccagatacagcgccgcacagcaaagaaaggcagccgatgttatgaaaagcgctgacagcagcttaatcactgccagcctggcttttccatatttggtgcaccggaggatgtcatccgcctgggtctggtattccgctgaaaataccggcgcagcaatgacggtgcaaaatagaaccaccaggaaaatcagcagcatctgataatcataggcattcgtattgtagcccggatagaacacaaagggcatttttaccttcgcatataaggccctggccttttcctgtgcagccgggtgctccttctgctccagcttcattaaatcatccagatgtgtgatgcagctttcataataatgatccagctgcttcggtgcaaggtctgtcagccctggcgccatgccggtttccggatctgcatagacctcggtaatccgcgacagcaaaggagctatggggaggatattttcctgataaataccgggagacagctgataggtataggcttttccggaatcattaagcgttttctgcgccgtttccagcacatttctcagctgctcctgggtgatcacgccgcccagatccgcctgtgcgtccctgaccagccgtatagcagccatgcctttgacctcggtctgctctataccgtccagcccgccgatatagcgggattcaaaagtgaccggcagccatgccatgattccggaaagtgccagcgatgccgccagcagcagccaggtggttttcgtcctgaggacccgtttgatttccagagtaaataatttcatctgccgcttcctcctttttttcctggtttctttatcccggattctttttccgcagcagcctgatcctcaggatacattccctgcgggaacagccacagatacagatcctccagccttggctccaaagccacggcggtttccgtttccggctcttcggaaagataacggatcgttatccggccgtccggttcattcttcagattgacgatgcgaaggcgtttttcacaggaaggaagctcacgggccaaaatcgtgctgccccaaaccttccccttcatccgctccaccagctcctgcgtcgtcccggtttcaataatgcgcccgtccttcatgatggcgttctgcatggcaatatattccacatccggcacaatatgtgtggaaatcaggacgatcctgtcatgggcgaactccgaaagcaggttccggaaacgcacgcgctcccccggatccagaccgctggtaggctcgtccagaatcaggatttccggctcgttcagcaacgcctgggcaatccccacccttcttttcataccgccagacagcttgcttatcttcttattcctcacctcatatagcgtcagtgtttctaacagctcagctatttttttatttgtattatttacagtcagccctttcagggccgcgatatattccagataatcctttactgtaaactccggataaaagccgaattcctgaggcagatatccgaaaatatcccggtatgcctcccccagcgcttctattctgatgccgtcataggttatctgtcctgaacctggctttaaaataccagctatcatacgcatcagcgttgtttttcccgcgccgttggctcccagaagcccccagacgccgggaccgatccgcaggctcacatcatccactgcttttttatctttaaattccctggatatatgctccaagcataattccatttccattctcctttccgtttaccgcttataaatccataccacagaacgcatagtaacagttcagccttcggccgaactgttactgcatccgcccattagagtcgccttcggcgaggggcggacgcctgatgcctccacgttttctcacggtctgtgcagtgaatgcacagaccggcctgaacggttacagcgcataccttttttggataaaacggcattgccgtgccccaaaggccagcaggcagagacagataccgccccagccaaggctgaagttctgccggaacaccaccgggcaatactcgccggcagccagaaaaagaagaagaagcgcagcgcacattcccgcacagcccgcacaaaaccgttccggcctcacatggcccagcagatagcatagccccgccgccgcaagaagaaacggcacaagcaaatataataccgcgccgctccggcttatggcggtactgcgcaccgtgtaccaaaatacgcaggaaagaactgccgcatcccccagccccgcaagaacaagccatgctcctgtcagcctgcccatggacatccgcgtggcgatttcagtttcaaacatccgataacgcagggaacgccataaaaacggtaccgccgtcatcacgataagaacggatatacaacaaagaagcagtgggattttttcctgattcaccaccttcaggctgccataagtaaaggtcagtactaagcgcagcaggccaagaagcacaccctgcatcagccatattttccagccgttaaaccggatctgccgcagcagaaagcctgtaaaaccgattcgctccctgtgttttccccggtacgctttatgcagcgcttccgctgtcatggccatccgttcggcatccggttccccgacgctctccttcaatgcccttcccagctctttttcccagttattttgcatctgtctctcctccttccttcagaattttcttaaggtacttcaatgcggcgcgcagccgcgattgtaccgtccgcagcggaagccccaggacatcggcggtttcccgcagcgtaagatcctgggcaaaccggagcagcacgatttccctctgcttttcgggcagccgttccaccagccgggcgagatctgcctcctgctcggcccggtcaaattcccgttccgtatataccagctcctccggcagggcctccggtttctttttccgccacatgtccacacaggtattggcggcaatctgataaagaaaggccttgaacctgcctttatgtacataccggtcaaaatgccgcaccgcctttagaaaggtttcctgcgccgcatcctccgccgttgcctgatccggcgtatgccatctgcagtaccgcagtatttcagggtaataaaggctcaccagctcatccagcccgccgctgtccccctgttctatttttctgaatatttcatcttcacgcgtcaagtttttcctcctgagggcgtcccctcatagattgaaacgtatgggaggaatgtaaatgattacttttttatttattttttcaaagcttacgaagcattgttattgttccaggctttgcaaccgatatctttgaccgcttcccggctgtaatcctgaggtcactgctcccgctgcctgctgtccccggcccatctgccaatctccgccgccgtcagcctccactgctcctgcggcgtgatttccgccctgccgtcgcccttctgttccccataccagccaaagccggcatgattgccgccctcaatcacatactcctctgccgtctttggaagatttacccggcactcctcatacttttccaggttcagcaccccgtcccggctgccatacacagacagcaccggcagagcttccggaagcggctttgtggaataagcggccaaaagcgccagcccggacagctcctctgcgtgctccgccgcatagcccgctgccatggctccgcccagggaatgcccgctcaggtaccattcttctatttcaggatatgccaacatcacgtcctcagccgcgctgcttcccagcaccgccagccgccccggcatccgcacaagcacgcagaaaaaatcctcagctgcaatttcgcgcatcagagggccataagcctcttcctccacctttgcgccgggataaaaaataaaaccgcgcccgctttttgtatccccatacgtaatccacgcatccaatgcgtccacctgtatctgctccccgccgccctgtgcaaaaacctcctgaatatccggcagcgcatggtaataagcctggatataaataaaaattcctgccgccgcaaataacaggacagccagtgctcccatgatgatttttctccctgcgccatgttttctttccttcacgtctgatccctctttttcatttttttaactgtccgctcagttcacagttaactatttttttattattctatagaaaaagaggcgttcgggcaacaccaacctccataacagttcagacaaccggactgttacaggcatcctgccgtttaaaatcgatgtgcgatgggcccgatacctgctttttctgcatattccaatggccagggatcccgtcagaacgatacccagtttctcccttttttagcattagtgcaatatgcatatttttttatattttgattgtatttattgtatattcttctttaatttatgtataaaatgagtttttttatcaaaattcatagaaattttatggcttactccacttattcatggtaaaatattaaaaccgttgttagtcaccgtaacagacagttcagtgatctgagctgttgccgtccgtctgccttttcatcaaggtcaggcgtttatgtattgacagctggaataataatgtaaagcagggagttaccctgcgggcagctgccgggattcttatatttatcacagcgcggcattcgccgcccatcccacagatttgtccgcaagaacgaaaggagttcacatgttgacgcacgaagaaatcaccagcctcgatgagattctttcaagccatgattacgacagcgcatccgttattgcaatcatgcaggacatccagaaaacgtaccgctatcttccccaggaggcgctgacctatatcgccgggaagctgaagatgagcgaagccaaaatttatggcgtagccaccttttatgaaaacttttctctggaaccaaagggcagatatgtcatcaaagtatgcgatggcacagcctgccatgtccgcaaatcaattcccatcctggaggagttccggaatatcctggggctgtccgaaaccaagcataattcggacgatatgctttttaccctggaaaccgtatcctgcctgggagcctgcggcctggcgccggtatgcaccgtaaacgacaaggtccatgccgccatgacaccggaaaaagcacgggaactcattaaagaactgagggaggaagcagcagatgaaaattaacagccgcgaagaattaaaccacttgcaggaattttacagcagcaggcttcatgcgcagactaaaaggattctcgtctgtgccggcaccggctgtgttgcgggcggctcccttttaatctatgcccgcttaaaagagctgatggaggaacagggcatccgctgtgaggtggttcttgaggaagagccccacgaacatgcagacggcgccggacacacctgccattgtgaagaatcagcccccgaaggcgcgcgtatcggcctgaaaaaaagcggctgccacggcttctgcgaaatgggcccccttctgcgcatcgatccggaaggccttctttacattaaggtaaaggtggaggactgcgaagaaattattgaacgaagcatccttaaggatgaaattgtggaacgtctcgtctatcaggatcagtccctgaaatcctatcccagacaggaggacattcccttctataaaaagcagacgcgcgttgccctggaatactgcggacatatcaacgcggaatccgtcagggaatacatagccgtaggcggttattccgccgtggcaaaggcgctttttgatatgacgccccagcagatcgtggacgagatctcggactccagcctgcggggcagaggaggcggcggtttccccaccggccggaaatgggcgcaggtgctccgtcagcctgaagaaatcaagtacgttgtctgcaatggtgatgaaggcgacccgggcgcattcatggatcgttccatgatggaaggcgaaccccaccgcgtcctggaaggcatgatcattgcaggaattgccaccggcgcacattacggttatatctatgtgcgtgcggaatacccgctggccgtttccagactgcagaacgccatcgaccaggctatggaaatggggcttctgggagacaatatccttggctccggcttcggctttaccgtgaaaatcagccagggcgcaggagcctttgtatgcggtgaaggcagcgccctcacctcctccatcgaaggcaaccgcggcatgccccgcgtaaagccccccaggaccgtggaaaaaggcctgtttgagaagcctaccgtactcaacaacgtggaaaccttctgtaacgtcgcccccattatcttaaagggcgcggactggtataagaccatggggcctgaaaacaatcacggcaccaaggccttcgccctcaccggaaacgtaaataacaccgggcttatcgaggttcccatgggtacgacgctgcgcgaggttattttcgacatcggcggcggcgtaaaaggcggcagctttaaggccgtccagatcggaggcccctccggcggctgcctgtgcatcagcgccactgaggatcacctggatatgcacctggattttgattccctcaaaaaagtaggcgccatgatcggctccggcggtctggtggtcatgaacgataaaagctgtatggtagaggttgcgcgcttcttcatgaattttacccagaacgaatcctgcggcaaatgcgtaccctgccgtgaaggcaccaagcgtatgctggagctgcttacggatatcacggaaggccggggaaccatggagcatctggatatgctggaggaactgtcccagaccatttccgataccgcgctctgcggccttggaaaaaccgcggcattccctgttgtcagcaccatgaaatatttcagggacgaatatatctcccatgttgtggataaaaaatgccctgccggacaatgcaaggcgcttgttaacctgcagatcgatcccgagctgtgtaagggctgtaccaaatgtgcaaggctctgccctgtctccgccattaccggagaactgaaaaagcctcacaccatcgatgtcagcaaatgcatcaagtgcggagcctgtaaggaaggctgcccgttccatgcaatcagctgatttgggccgcaggtatactgttggtatcttcaccggtaactgtgaaagtattggatagttacccacagatacagctgcggtacataatcagacatttgcacgcgttatgaaaagctaagaggagaatttgaaatggcaaaatacatgataattgacggcataagggcggatttcgatcaggaaaaaaacatcctgcaggtaatcaacagcgtaggcatccatgttcccaccctttgctattattccgatctttccatatacggcgcctgccgtatgtgcatggtggaggacgaacggggcaatctgattgcttcctgttccactcctcccaaggataaaatggtcatccgcaccaatacccccaggctgcagcaccaccggaaaatgattctggagctgttgctcgccgcccactgccgcgactgcaccatctgtgagaaaaaccagacctgccgtcttcaggagctggcgggccgccttggccttactgatgtccgttttcccaatacgagagaagcacagcccgtggatgattcctcagtttccatcgtcagagatcccagcaaatgcatcctttgcggcgactgcgtcagggtatgtaatgaagtacagcacgtaggggcaattgattttgcaaaccgcggttcctccatgattgtcaccccggccttcggcaagaagctggcggaaaccaactgcgtaaactgcggccagtgcgccgccgtatgccccaccgccgccatcaaggtaaaaaccaacctggataaggtatggcgtcagctctacgatccaggcaaacgtgtcgtcgtacaggttgctcccgccgtccgtgtcgccctgggcgaagccttcggtcttgctcccggcgaagacagcatcggcaaaatctttaccgccatccgtatgctgggctttgacgctgtgtacgatacctgcgtgggcgccgatctgaccattatggaggaggcaaaggagctgggtgaaaaactggaaagcggagacgaccgtttcccgctgttcacctcctgctgccccgcctggatccgttttgcagaaacgaagcatcccgacatcatgccctacatttcctcctgcaaatccccgatggaaatgttcggtgctgtcctgaaggagtattataaggataaagataaagaggaaggaaaagaaaccatctccatggccgttatgccatgcgtagccaaaaagatggaagcggtccgcgaagaattcatccgggacggcgtgccggacatcgactatgtcatcaccaccaaggagctgatccgcatgatacgtgaaagcggcatccagtttgatgaaatcgatccggaggctcccgacatgcccttctccatctcctccggcgcaggcgttattttcggcgtaaccggcggcgtaaccgaagccgcactccgccgcctggttcaggaaaagagcacccagtcgctgcgtgatatcaagttttccggcatccgcggcatggaaggcgtcaaagaagccgtcctggaactgaacggccgcaccctccgtatcggcgtggtaagcgggctgggaaatgccgataacctcattgaaaaaattaagagcggcgaagagcattttgattttgtggaagtcatggcctgtccttacggatgtattgccggcgccggccagcccttctgccataaggtggacaaaaaagagcgtatggcaggcatgtaccgctccgataaagccgctcccatcaagagaagtgaagaaaaccccgtgatttacaatctgtatcacggcgggctgctggaaggcagagagcatgagctgctgcatgtgcactataaaggggcgcagccgcaggaataatagccgcaggaagaaagtggcgggaaaagtggcgggaggtgctttcatacactgcatccatggattcccatcatataccgggaggataaaaaaatgctggttacaccaaattttcattttcatggagactgtgaagaagccatgctgctgtaccagaaggctttttccggagaaatcacctgcatgctccgctatcgggatgccaatccggaggattattccgccgacagcagatgggacgattatatataccatgcggaaatgcttctgcacggcacaagaatcatgctgtcggatatggagcctgcggtaccggcgcagcgtccgtcttatctgccgctttccctggtcgtgacaatggacacgaaggagcaggtaatgcaggcatttgaggcaatgaaggacggtgcagaaatcctttcgccgccgcaaagcaccacctacagctcctgttttctttctctgatagacagattcgggaaccggtgggaaatcatgacagagcagacgcttcgttaaaaacagaactatcctgcaatagattttatatgtttcttgtaatttgcctccgtgataattacatttcagcaaacttccatttatcggcagaatataaataataaggcctccggtcatgtatttaataaaaatacgcaccggaggtcttaacttttttaaagatactatttttatgttccgttactattacaatatcatgcagcttaaacaggataaacgcatccgcgtaggagccgtgcttcccgccgtccaaatctgcggcagccagccgcctttcttcccggatggggtgggggtgttttaagatccataagaaaaaacggcggatatttcttactgtcccggggaaccggaattttgccgtccctagcggcctgtctgacgaacgcagcagacgcaagtcgctgcgaaaggagtttgggccgcgttggcagaattctggttccccgggacggttagaaataccccgtttttgaaactggatcttaaaacacccccaccccatccgggaagaaagacagctggctgccgcagatttggacggcgggaagcacggctcctacgcggatgcgtttatcctggtagcttaaccgtcactcaaacggatacctgattccccactcggctctcatcgcatccatcattttcatcacgcggatggtttcggcatgaggcatctgagggcattccagacgtccctcctccagtgccctgatgcaggcctccacttcgtattcatacccgctgatctgcggcggacagtcaatgtgcttgatttccctgcgatcctgatcgtaaacagtaaggctttcaaaattattgatgttttcaactatcatgaaaccttttgtcccgtaaatgattcctttcctgtcactcagggaaagcatggagctgttgagaacggcaacttttccatcttcataaatcagcgttgcactgttctgctcgtccactcctgtatccgtataggtgcagacggaagaaacctttgccacctcgcccccgaaaatcatcagggcaaaattaagcggataaacacccacatccagaagcgcgccgcctgccagctccggcctgcgcagcctgggtacctggctgataacatagccaaggttggctgtcagcatagtgggttcaccgatgattccatccgccagttccttccggatggtttccagcatgggcagatatctcacccatatggcttcagtaatgaatacgccggccttttccgccatttcaagaagctcgcacgcctgtgctgcattggcggtaaacgccttctcacaaagtaccggcctgccatgggcgatacagagctttgcattttcaaagtgttcggaatgaggtgttgcaatgtataccaaatccacattttcatcccgcaccagctcttcataggagccataagcccttgcaaagccatattctgaagcaaaagcctccgccttctccaggcttctggagcctatcgcatagcgctccacattttccatttccgcaatggttcttgccatacaggaagcgattccgcccgctcccataattgccattctcagttttttcatatcattttcctgctgcggcgccggctattcaccggactgcgccgcgcatccctccttctttttatgtgatatccctgattctttcatcatattccgtaacgcctttgaaacgccgattccagggcacttgtctcccacgggaaaatgcagtatccctctgcgcctgccgccgccagctccttcagccgttcaaaatcaatccagcagaccgactccacctcttccgcctgaagccttaagtccgcctcgtttaccggcttctcgtacaaatataccgcagatatttcccggtcaaggatatgctttcctccaaaataatcatccacctggcagggatagattcctgcaaaatacagctcttcaccagaggccgcaatccccagctcctcttcaagctcccttaatgccgcttccagaaaggtgtctccggcagaaagatgccctgcgcaggaggtatcataacagcccgggaagctttccttcgtccggctgcgtttctgcagcagcagctcaatccgcccttcccggcggcgcaccagccatatatgggcggtgccatgccagtcaccgtccctgtggaccgcgcttctttccttcacctcacccgtaggatctccctgcggcgtgcggacatcaaacatttccattgctgttttcctgcctttttactgtattatatacctccggattttttaccacgcaggcgctcactgaatcacaaataaacaatcgctggcaaagggaccgtctcctccgttataaatcttactgtttcccatattatcagaaacggaaactctcttcagccggtaggtgcccgcttctttggtctggcttttctttatcaccgccgaatataaatcgcccttcttttccagattcacggtgacggcctttccgttttcgttctcaaaacgcaccgctaccgtatccacgccggaaaaatcatccgcaaccgcagcagtcaccgtaatttcggattccctggccgcccgggcaggcgtcaccactaccgctcccagcactggcggtgtttcgtcagctgccgccacgccgttcataatctggaagccggcggtcacaggaagcgtctggtatttgtcgttttccttccggtcctctgccctgcaatatttcagataccctccgttattatcctgcagtatcaccttatccagtacaaaaaaaccggccggctcataaatactcatggtcatccatcccgcataaacaccattcgcaaagtccttatcacggagtatcttggtaacggtcctgtcgtttgccgtatttttaaactggatgttgacatgatcgattccggcgggtccaggcagcgcctgaactgccacatagaccttcagctcggttccttccgcctgcattgccccggccgccaccgcgccgagaagcatgccggttgtattatccgcccctgatggtattcccgggacggcttccgcgggaattcccgggacagcctccgcagcctgtgtacgccaggaaggcagcagccacattattgccagggccgctgccgttattattgctattccccttttgcctgttttcattcaaccactccttttttacagccggcgcagtaaatatactggcctgccgaacagttacttttattctatcatatcagaaacaaaatggaagaatgccaggcaaaagattctatttttttatgattccttgttactgttcgctccgtggccagtaacgattccttttctataatctgattgcagtatagttgcagaaagacctgtcccctgtccggcctgacagccggaattgtctgtcctgtctcaccggctgaccaggggcatctccgtcatacgcagattggtgcatccatagggctgcagaagcttttcctccggctgcgacaatgccctgcgctcctgcggcagatgggcgcagactccgccattttcctgccaggggatttttaccatttccgtttttatctgcaggggcggattatctacagcaaaaggatattctcctatttcattgccgcgcacctcaaacgtttccgtgcagaagccgtaattccagtcggaggccggcgtcagctcataatcgcagtaaggagccttgcgttccacgccgtccttcacatattccagctttctgcaggtttccgtgatgggcagggaaaaaaccagcgggcctctcaccagggctttcatatcgttcggccggtctgtaaggacaggcacaaaggaaaagctcaccttcacccgggtactcccctcccatttacggtaaatccggtaaaagcttcccggctccgccttttcaccatccaccagcgctccctgtgcaaaaccgggaatacggacaagaagctccatttccaccggccgctccgccgtgatttcaatgacggcttcatcacggaagggatacccggaaatcacctgcagtgaaactgccgttccctccttttctatccttacggaaacgggaaccggcgacatcacggccagcccgtctgcgctcaacgcaaccgccgacaatgcgaatttcggccaggcctgattaaagttcgccgtgcagcatccgaaattcggctccagcccgaacatatgggcttccccgccattggaattaaagggcacctgatccggcgcaatcctgctgcagcagatctggtttgtcatctgcacatactgatgcgcccacatatccggcgtcgtagtggcaggcagacagttaaaggcctctttttccagcagatcgccccagaagggattcccgctcaccgccaggaggatttcataggaatacatagcctcggccacgctgcagcattcgcttccctggacgggcgaatccccggacaagcattcgtcccctgtaaaatgcccggttgccatgctgttataccgcatcactttttcatacatttcccgtgcaaagccgtccgcgctctcccctgtaagcagggacatcagcgcccgggatttaaacgccatggctgtattcaccacatggttaagctgggtccagtacttatccacagccgggtgggcgaagtcaaaattccggtaaagcttttcataatccagcccctccgcctccagaacaaaggccagcttcagcatccagtcctccggccttctctcatacagccagagaaggggaaccaggcactcataccacctggctgccgaccagttaaaaagcgtactgtttgtcacatgcagcagcagattatgcatcgcccggtataccgcctgttcgatcctgtcatccccgctgcattcataatacagcaccagcaccttgcagatcagaaacgccgcccaaacgtcataggtgctgcgttcctccctggaacagggacagatccagccgtcctcctcctgacgctccagaatggcgtctatgtatctggccgcacgtttttttaattcttcgtcttccagaagataggccagggggataaagccgtccagccagtagggcacgcgctcccacccttccttgtctccgcttatccatttgctgtcacggatatccggccatatcagatccagatgcccggaaagcccctccgcctggattttaagctgctgtctgagccatccttccggacgaagctcctttgcggtgaggggcgtaaactttttctttttcatcacatatactccttttttgtttcttttttcctgtgtttgttttatgctgtatttacgggagcaggccgttccaaaaggcccgcaggatcccggcaattacccatgaaaggcggtgcaagctgtggattccatcattctttccccggctcccatgccctatcttaccgactgcagcctgaagcgcttcggcaccgatgaataccattgttcccgttactgcagccatttcgtgctgattttcatgttgaaaaaccggctgcagttcacagaaaacggcagcctgaccacgctgttggcaggcgaatggtacatccagaaaaaaaacacctggcaggcagcttcccgccccagccccaatgcagaatattattacatccatttccaggctgattataccgaagatctcaccagcaggctgatgcttcccattagaggcgccttccagccaggcctgtttctgccgctgctgcaaaggctgtgcctgctcctgcaccagacgccctgcagccatctggagctgcagagtgaatttttccggcttcttggtctgctgtatacccaggaacagtcatactcggcactgacggcagatctgatgcgttacctcaatgaaaattatgcgtcccgcatcactgcccggaccctatcggacgtcttccattattcttccgaatatattgataaaaaaatgaaggcggagctgaatatgacgccgcatgcctatctaaccgccatccgcctgcagaatgctaaaaagctgctggaacgctcccagctgccgatccagaaaatagccctggaatgcggcttctcggacaactcccttttttataaggcctttcggaagcatttttcacaaagccccagtgaatggcgcaggcagcatcagttcgtctaccagacggcggacccttcctctcaatcatagtatgaaccgaaggaagttttaagttcaaaaacagatgtatacattgcaaatctggtactaaaaaaggcagcccccggagtctcccccaaaggctgtccttttacgaaattttattccagtgtcagcatatccctgtgtgcgatcagctgtcttagcatcttttggttgatttctgccagctccgcatatttttccgactccgaaaaatatgccacgcaaatcatctgaatggaaaatacaatataaggaagcgcttccttctccttttcagacagcgggttgacgctgtcatagccccggaggatattctgatagagcaatccccactgccgcagcttttcctcattgccgtcttcgaagctttccgacagtatgcccgtggaaacatagcagggatcaaagagccggatcgccttttcggtattttcaaattctataaaccctgccggctttccttgcctgattaagaaatcgctgggcgtaggattgtgatgaatcagctgtaccgggagcattggatagagcgcttccagccctttttcaaattcactgcagaattcgtcgggcagttccatcgccctgcgcgcgcccggcaacgcccagcccttgatactggccagcagagcatcctcctgatactcctcctgttcctccatatccttcattatcagatgcagctgtcccaggatttcgcccacgtaccgtgccctggaatttccctgctctgcgtataaatcccgggccagcaggaattcgccttcaggcatccgggtcaggcagaaatacgtatcttcatccattatgtatttctccccgttttttgcaggaacatatacggcagcctccagtccggcctgacgcactgcctccgacacctccaggtgccgcttcaaagccggcaggttttcacccgttttgagaagataattttctcccacataccagcatcggtcggatttaaagccgctggattcataataaaagctgctgattttttcctgttccattccccaatgggaaagtatttccttaatttttttctgtgtaagcatcacatgtccctcctgcctcaaattgattctgtatggccgtttgggtttatgccgtttcagataattggagggggaacagtcatattcccgccggaaagcccggaagaagccggcatgggtatcgaagccatagcgaagggctgcatccaccatttttgctccgcagctgatgtcatagatggcatgcaccagccgtctgcgcagaatatactgcatgacaggcatgcctacctgcgcctgaaacagccggtaaaaatagaacagggaaaatccggcacggctgctcagctcctccgccgtaatctccgtatccaggttatcttcaatataatccaggctctcctgtattgtatcccggtaatccacagcgtgtatctcctttttctgatttccggcctcccggccatcgcagttaatctctgccgttgtgttacccgccagtttttctgctgactctatcttagcattgaggcattgagaaaacatttcctgttttgccgcattttttcagttgacaggaaaaaatccagcgccgcatcattccaccgcaacgctggataccccgatattaatcaggaagttttccaaaatttctttcttttcctgatacaattcatttgatattgaataagaaacaacatagacagcaaaatcattgtccggtatgtgcagcacaagatactcctcccgcaccacactgccatcgtcctcttcaatctccttcacatacctttttccctgcagcccgtttgccgtactgaaatccatcccttcatcctgcggcatttcctccacgcctttggttccgtaaatggaaatttcattgccgctgtctccgtcaatgtacaggtcatagccccattcgtagctgtccattttctcgcctgcattgatcttttcataggtatcataggtccagtccttcggcaggatcataaaaatactgtccacaaagctgttatgattaaatgtatggctgattacgctgatttcgtcctggctcataaccgccgcctcaccgcccccatttccctggcagccggtaaaaaatacggcgccggaaagcaggacggacaataatattcctttaagtttgcgcaagctgcttcctcctgacttatctttattcccgctagcaacgagccaagcagccatgcttacatggatatttggcgactgccgcgaggttcaaagcccccgctgctctgcagcgctgcaagtttgatacctcgttgcttgcagcgggggctttgatttccttccagttatttaaaagttttgggatatcatccatattatagcaaataaaaaaagccttgaatacacaagactttttttattgcagactttttatcatgctttgtaatcgttcaggtattcggtctgttactataactcatgctacaatacatctaaacgtctataccaagccgataataagttccgcaacctgcatatcagttttatcaggattttccgacagcagatcaagtgctttctttacataacaaacatccagctcaagtatatcggctatttcatttatgtctaagcctttttgagatttttttctgattaatgatattatcgtctcagcttcaccaagtgcagctccgcgggcgatcccctgggcaattccatcttctttgccgcttttatactcactttcgcggatttttttcatttccatttcttcattatactcaaaaattgacaccgctatcacctccgctctctgtgacaacaggaaatctgccagaatcccttccctgatacattccgtcaagtagtaactgtgaggggtaatcaacagttacaaatttttaataaaactaaacgcctatacctgtccaataataagttccgcaacctgcatatcagttttgccgggattttccgccagcaaatcaagcactttctttgcataacaaacatccagctcgagtatgtcggctatttcatttataccaaagcccttttccgatttttttctgattaatgatattatcgtctcagcttcaccacaggcaatcccatcttctttgccgctcttatactcgctgtcacggatttttctcatttcctcttcttcattatactcaaagattgacaccgctatcacctccgctctctgtgacgacaggaaatctgccagaatgccttctctgatgcattccgttaccgcccgctcaaccgcttcctcaatctgcattctctttgcatattttctgacccggtccacatactggctgtattccttcaatgtctggcatttatccatcagctcttggttatgtccaaaattaatgttcagcataagtaccttaagctcaagctccggttctgccgtctctttttcaaaagcatccgacagccacaggatttgcctttccggctgcccgtccgtgccgttgtaaaataccacgaaccggggcaccggaattttcaccagcgtggaagaatatatggtctcatcccgcgtatatttttccagctgcttggcaatgtacaccaaatcccgcaacggcatattgggattatacgaaccctggtgctcgtacagattcatctcggaatccagcaggaatgagatgtcattcttaaaattcatataaatcgcattttccagggtacagattgtcaggtcctccgggctgttatacgctgaatcattgagtgcattatacaactccaacagttccttcttttcccgaaatagcattcggaaaaccgtatccttctgatttcttactacgtgcagttcttctgccataagctgctcctttctgtttgtgtgcggagcaaccttcccaatcagccgctcctgctttctttgttggatagtaagcatagagtttctgaattgagaatggaaattagacggcacataggccaagattcgttagaaatttatgcttgcgtttattttatcactgtttttcaatagattcaactgctcctgaaattttaccgtcttctttttccgactcaatacttttaacgtggttaatgaccgtacgtttccaggtattgctgtaaatcacgccaaatataaaggaagtaaaaaggacggcgccgataaacgtgctcataacaaaaataactgtcttccttttcagcccaagctgcataaaatgtacctttgcattttccagaagtttcctcaacgcctgcctgctgcctgttttatccttattgacattatctgtaccgttatttgccgtacttgttttatccatgccttttccccctcgtgcatgatatcccttaagtaaaccctgccaaagcccatgtacatattacaccgcactttagagcaattataacattgtaactcctgccgcgccactactgccaaagtgatgaccacccaaccgctttaagcccttctggagccctcccgcttgacatccccgccccctggcatataattaattaaaaattttatattttcgtgcaacgtttttcctctcccggttgtatataaagcagaaacataaaaacgcatgaaggagaatccgatatgaaaaaactaagcctatgcattatcactgctctgtcccttgtatcccttggtatccttaccgcctgcggcgtttccgccacgccaaaggaagccggctcagcgcagcttcccaacccatttatcccctgcgcctccatagaggacgctaatgaaattctgggcttcaccgccgccgtgccctccattctgccggacggctatgaaaccgccgccattgccgccgtttcttcctccgatccggcctttgtacagataagatacgaaaatggggaaaagactatcacctaccgcataggaaaaggctccggcaatatcagcggagattacaactcctacgaattcacaaaaacactggaagcggttgaaaatatactcacctgcagcggcgccggagaactgatttataatgcggtctgggaagcggacggctatacctacagcctgaccgccacagacggcatcaccgaaaacgaactgcaggaactggtggaaagcatcgcctgaagcattccgcgccgtatgaaaggaggagtcacattatgaattacggcagttccataagccggaccgcagccgtcccggggcagaaccgatcccctctgtacctgcttgcctgcggatggctgcgttttatcctgtacaggctttgccgctttattaaaaaggatgcggacctttctccctctccggaggccgccgtgtccccgtcatcatcagagcgggccgccgggattctccaccatctgccaaaaaacaaggcctccaaaaccagccgggtcaccgaaatcagccagggcccaaaaaccagccaggcctcccatgccagccaggcctctctgatttcccggccatcccgctcctgccctcccctctcccccgaggaagccctgcaccgctatggttcccccatcctccgtctggcgctgtcttatctccataacctgccggacgccgaagatatcctccaggaaaccatgctccgccttttctcctccgccccgtcctttgaaagcccggagcatgaaaaggcctggctcttccgggtggccatcaacctgagcaaaaaccgcctgaaggccaacagacgccgcagctgcgaggagcttcccgaatccctcacctgcgccatgcccgaagacctttcctttgtctgggaagcggtatccacacttcccataaaataccgggaggttatccacctttactaccaggaagaaatgactgccgcccggattgccgctctgaccggcgcaaaggaatccaccgtgcgctcccttctcttccgcgcgcggggtatgttgaaaaaacagttaaaggaggcgtatgattttgaagaataaatatcaacaggctgaagaatacattaaattgacaccggacatggaacagcgcattctggaaaaaatcagagcttcgcgcaccgccccggttccgcagatacagccacagccccccttcccccggcgttttcccattcccgccgccctggccgcctgctttgccctggctgtcctcaccctgttcttgtatccccgcctgaaaaccggcttccccccgggacaatcccaacagccgccggtccaaatagcttcccccatcgtggaatacccggatacgtcctccctggcggatgccctgccatttccgctttctctgccggcacagcttccagagggctataccctccgttcctgctccatcctgaatggagagatggcacagcttatatatgaaaaaaacggctcacagctcacctaccgcatcacagaacagaagaatgccccgggagatgacataagcggcgattataaccagtatacgcagtcacagatcctggaacggccctggggacagctgacactgaagggtgacggcaccgcatggtccctcctcctgtggtcccgcggcggctacacctgctccgtgtccacacaggccccgctcaccgaatctgaagcggcggccctggtggacagcaccaccctgtatgaagctgaagcgcctacacagtaaatttcctctgatatattataagttcaaaaaagggaaaaaataaaaaggaccggaaatccagcataaatccgctgtttcccggcccttcgttttatttcccggcattaatgcagttttttcaaagccggccagctatagacaggctgttcgttaccgtcctatagttttagcactgcggatttgttcggaattttattttaaaaattatacttaaattcccatttcggaatatttattgttattaagaatatcatatgctataattggaataatagtcaaagaccccgctgcaagcaactgggtatcaaacttgcagcgctgcagagcagcggggtctttgaccctcacggcagtcgccaaatatccatgcaagcatggctacttggctcgttgctcgcgggaataaacaggaggcagatgcgatgattgagcgaaaagaatatttacagcgtctatatgactggaaagacgaacaggttatcaaagtagtcaccggaatccgccgatgcggtaaatccactctgctaaagcaatatcaggaaaagcttatgcagagtggtattttaccggaacagattatttccatcaattttgaagatttggaatatgaagagctgctggactacaaagctctgtaccgttatataaaagaacggctctgcgaggggaaaatgacttatatttttctggatgaaatccagaaagtggattcctttgaaaaagcagtagacagtatctatataaaggatatgacggatatctacatcaccggttctaatgcctatatgctttccggtgatctggcaacactgctgaccggaagatatgtggagatttccatgctgccgttttccttccgggattattatgctttaacggctcctgagctgtcacctgatgccgcttttgcggattatatgcgctacggcggctttccatatctgtccacaatgaaaaagacaccggaaaaggctgcggtctatctggagggtatttataataccgttataataaaggatatcgaagaccggcagaaccgcagggaaaatgatccgtccaagcggaaaataaccgatattgcactgctgaaaacaatcgcccgctatatggcaagtgtggtcggcagtcccgtctccgttaaaagtgttacggattatctgacctcaaacggacgtaaaatctcccctaacaccgtaagtgattatatggaagccctgaaggaatcctttatattttataaagccgatcgtatcgatatcgttggaaaacaatttctgaaatccaattccaaatggtacgttgttgatttggggctgcgcagccacatgctcccccgacagaagtatgatttaggcttctccattgaaaatattgtctattttgagctgctgcgccgcggctgccaggtcaatatcggaaaatcagggaacacggaggttgatttcgtcgcacacagtcaggatgcctgctgctatttccaggtaactgcggacatgacctctgaagaaaccttctccagggaaatgaggccgctggaatccatccgtgacaattatgaaaaaaccgtcctcacgctggacagattcaccgccggcaattacaacggcatcaaagtaatcaatgttattgactggctgctgaatccataaaatcaaagccctcgttgctcgcgggaataaaaatgccgatccctgaagctgagaaactactctccggggaccggcttttcattttaaaatcaagggcatacgaaagaccagggcagacagattgcaaaaatattttttcacatatgccgaagtttaccgccccgcctattcaccaaaaattccgcactcctccagcgtttttccatccgccgaaagcttcagcgtcttcacctcaaaggggtgcatcaccacctgacactgcgcatggaggaccggcacgctgacacatgcctttctttcctgccccgtggattcaaacaaacgcagcagaaattcgttctctttctttcccctgcgtaaggctgaaagcaccactgccggatcgtccacacaaactacgccttccggagcttcctttccttccgcttctccggaggggaaggccggcactgccatgggcgcttcctggaagcagatggcctcccgggtaatgtattcccggcgctccctgcaatctcccgcattcatttcgaactcgaaaatcctttctccctgatctatgtagggaaggaatcgatcctgtacgagcagcggcctgtctccgatgggatgcgcggcatataccgcagaatgcaaaagggaaatcctcatggtgccctccaggaaatctacgccgtagtttcctttgtttatcactgtaagcgctttgcccgcgctctcgtcaaacagcccgcaccatcggtggaataccttctcccttccgtcgcattcatgctccatcacaccataggccgtttctgccagcgcggccgccggtatcagcgccgtgggaagctccagcttcagaaaagctcccttttccgcccagttaacacggacctccgttttcacctttgtacccttggccggcagataataccggatataagcctgggaattaccataaccaaaaactgcctcaatcacccgtcttacaggcccatcctcaatgatacggacgctgggaatcaggcagccctctcctgcgtgacgttcattcagagtgccggaataacggcttccctctttctcatccatcagatgaaagctcccaatctcttccctgtagctgcaccggttcattccccagggatcacagtccgttttcatcacagccagccgaaaagcgccttccctgaggtactccgtaccgtccacacagtaggaatccagatacccggtctgcgggttgatttttacccggatcctgtcgttggcaaatacaaagctgtcgtcaccgcttacctgcgcacgctccggcttcttatccaccatctggattctcgcggaaaaacggttcatgcaggccggctgcaaaaccgcgcggaaagtcacccgcttacgccagtccagattcatattgcagctttccttttccacctggctttccagaacctctccgttttggctgagcacgggaagtgcataggaatctgtccagttctggttggcaagctggaattctccctggaaaattccttccacaggaaaaggatggggattgtaaatcagaattggatattccccctcctgcgccttttcctctccggaaagcagggcaaagaaagccctctgcttccatctgtgcacgatttccaggccgtgatccagtatcctcaggccgccctcctcaacctcttggatggaggaaccgggaaggacatcatggaattcacagaacatcagcgcttcctgcgcctccttcagctcctcatacggataaataagcagtccccgcagcgctgcctgggaaagcattttttcagtcacacacagctccccttccagctcacggtgcttctgctttatccttatctgggacgtatagcagcccacagcccagtaattcagatccttttccaccacaggctccgttatccccgccttttttgcagcctcactccttgccgcaaaatatgcctccggcgtggagtggaccagattccagtcctccgtcctttccttcagctccctgagcgcttccagatccgcgcgggacggcccgcctccgtggtttcccacgccccagaggacacagcccactgccggctgctccccttccggccggctgcgctgccgatccatccattcctccactgtttttccggcctctcccatcagtgtgccataggtatccgccctgtgcgccgcgatccgggaaccgtcaaaaccaacccagatgaaatcatccgccggaagcggacagttcccctggccgggcctgcagaacagataggaatcataccccgccttcgccatcagctggacaagccccctgctgtggccgaagggatcaaaattgatggcggtggagggagcctccccgaatttttccagaaaatattccctgccgctctccatctgccggataaaggattccccgctgggcatattacagtcgggctgcagataccagccccccataatatgccatttcccttccttcaccagcttccggatccttgcaaaaagcgccggctccatctcttcaatccagtgataaatcagcgcctcattgtggttaaaaaccagcccgtcatactcctcacagaaaacagccgccatgcggaacgtggaaatagccgcggaaatcccctcttccatatcccacagccataccggatcaatatgcgcattgcatatcaaatgtaaatccttcatacctatccctccatctgcttttaaggcgcagccgcctgttataaaccgtaacactccgggacggaaaccgtcccggactattctggcaaatcatacataaacagcttaaaattcaattacccattcatcctgcatccgaaggggaagcataagctccgtaaagccgcagccctcctcctccacgccgtttttcagtatccgcttcactgggttatcccctttccagcggagggtaattgtctcttcgcacccggccgtcagcttcacacggctgatccggtaatcctccatgtcaatcgtaaccttatgcccgccttccaccgtcaggccgctgcagcctgcgctcttccactcatccggcatccccatcagcagccagaccgtatccagcgccctgtgcacaaacatttcacacagcgccgtgggaacaaagaaaccgctttccagcgtaaaggcatcggagctttctcccgcattggtatctgaaatccgcagtatgccgttctgataaggatctccgtttacggtgaaggaattcctggaacggaacaccatacaatataattccagcatcgttcttgccatatttcctcttccacaccgggaggccataatccccaggtacgggcaggaaaacgcggcaaattctaggaatccctgattgatcgccgtatccagggaacgctgcgccacctcattatgcgcctcctcacagagcggataaatggggaacaggtggcagaaatgcctgtgggacgcaaacacatcgatcccgtcaaacagcggcagtcccttttcattcgtcttcaccggcgccagcctgccgccaaaggctttccagcccgaaccgtccagccccagaacctgtgcatagccctccatcttccggcacagataatgcagacaggacaaggtaaaggtggcatcatcggcaagaagcatatggccgtcccgatccacctcaggagatgtggtaaagggtatatgcagataaccgtcctctttttcaaaagcaattccctgatacagatgcagcaccctttccacaaacggataaatcttatccctcagcgtatccttttccctgctgtattcataaaaccaggtgaagtccacggatacgaaaagctccggccccagaatggtattccagaagcaccattcggaggcggccccggttccgtccggcgccatcatggtggggatgtggatcgcatcccggatgccgaataatttccaggttctctccataaaacgctgcgaagccgcggaataatagtctatgtaaggccgtaccagattcacattgccggttttatacgcaggccagtagcaggactgcacgttcaaatcattgtgcagatccccgaaccaggccggcatgcggtggttgggattccataccccctgcagagtaaccggagaagaatcttcacgctcattgcagtaaagcttgaacatctcctgccaaaaggcctcctgcagccgttcattgggcacccggatatcgaagccgctccagaatttttcccagtccccgcggtgcgcctccaggaagacttccgtccgcgcaagatagtcaagcacaagggcgcttccttcctccgccatcgtttcttcctccgcctgcgccccggtcctgatgctgaccgccagacgcagcccttcctttcctgcctccttaaaggcctgccccgcagcattcagcacagcgctcctgtcgccgccaaagtgctggcggacaacaaagcagccctccttttccgtctggatgcacggctcataattccagtttttaagcggcctgagacggggcgaatccaaatcccagcccagtgccttcacttccagggaattggctccctctccctgcagctcaatcataaggatattgacgcaggaatccagatagatccgtccctccgccttcctgtccccttccatttccagggaaagaaacgtttccgccttttccagatccgtttccgccctgaagccggtaatcgatcccggaagctgcagctccatcgccagggcaggcagcttcgtcctgcctatatgctcttcaaaaatatccgtctgctccacataagcagtatccccctccaggtactcctttttatgcttcaggatctctgaaaatacagccttcggctcatccggaagtgtttccctcagctcccaaaggcctacgtgatccacggaaatacagagctttccgtcctgcacatacagcactgcccccatcttcccatttccccagaagggtccttcacaaaactggcggggtatcctgtccaataccattttcctgtccatctttatcctcattccttcctgtcataattcagcttccggaattcattgggcgtcattccctttatccttttaaaagccgtccgcattacatatacgctgttatatccggtctgctccgcgatcttttccacggtcagcccttttttcagcaggctgcatacctgttctatgcgcattctctccagataagtggcaaaattctccccgaacagctccttaaacagcttggaaaaataggtgctggcatatccgaaatcatccgcaattttcgtcagtcccatatcgctgtcgcagtaatgggcgcggatatattcctcaatctcctccgcctgcctgctgctgctttccttattggccgccttaaccatgtcgcagatatacttgaacagactgttgatccggttaaaccggaggaggatgtcgttttcacggctcagctgctccagctggcggtaaatttcctcttcctcaatttcaacccggttattcaggctgtgaagcactttgaataccgtacactgcaaatcgtttaccaggaaatgcatcatggtgggactgatattcctggtcagcacgttcacctggtatacctcgctcagctgcgcgtgcatcgcttccacattccctgtgcgcaccgcattcaccagacgttcctccagcgtcaccgggaaataataatattccttgctgtcctgataatccccgtaaaagaacacgtattttccttcgcccgccccgtaggtgagcatatcataggtctgatcataggccttgccgatttccgtcatatccttgcatatgctgctcacggcaatccgcacccttacgccgtattcctcccagaacgtctcgctcatatgctccagcttctccagaaagcccgccctgggcggctggaaatcatcctccagcgtacagatgacggcgcaggaatccatgtccgtatcgcacatgtacttgtctcccgaaatgattggctccagcccctggtgcagcacctgcttgtaaaccaccgtttcaccggtatacatttccacctccgaggtgtccgggccgccaatcagaaaggcgattaccagcatcctttttccccgcagacatataccgtaatcctccaggctctgcaggctcacaccctctccgccgtgaagcagccgctccagcagcagccctctcgtcaccggcttctgccggatgatgctctcctgcagccccgcattattatctatcagctgtttcagggaattggatatatactccatctcatcccccttcagctcttcctctgcctctgctcccaggctgaacagcatctggaggataccgtcaatccttttcccccttttccaggataccagcaggatgctcccgattcccacaaacagcacggccacaatcagcaaaaacagcttctgctgatccttattgatctgcaccgttatgtaatccttgggcagcacggaaacataggtcagccccaggtaatcggaatcaatgcggatgacctccgcctttcttccattcagcgtcacctcctggaccgcccttccattccccaaaatttcctccggcaccagctcaaacgtaccgtctgccgcaggaaccctcagaatcgtttcatcctcctttttatccagaagatatgcccagccatcctgggaaatataagcgtcgcgcatgagatttttcacaccctccgaacggatgggaaaaaccaggcatccctttaccccggaatcggttaccagggactgcacgaaaagaagccgctcctcctgtttgccattctgcatcgtcatccgctcaggaaagaactgctccgaataatgccccttcagcatcagctgccaatcctcccaggacatatccccataccggaaaaaagaacgcagggtgtccttatacagatatacgctgtccggtgtaataaccatgtccgcatcctggaagtacacataatactcctccacaaacgtctggatctgcatggctgccatgtattcctgtgcgtattgtatcttagatatctctatctttttatcttcctcatccatctgcgtggcaatataccggatattactgtttgcggtcagccgggcagtaatcgtattgatttcccggaaattattatccagcatgtccatggtatgggacatattggaatatacactggcacagatattttcccgcgtggaaaccgagatgttttccagcgtaactatattgatgatcaatggaagcaggaagattgccaaataagtaataattaatctgatatatacttttctgtacttcatctgcggtacctgtccgtgtgcgccacccggcactgcacactgcggcttcctgccgctccctttcctcatatctgctgccatcggcgcgccggtgcttatgtgaaaatccatacacgccgtctgcgcgttccccagcgcgtctcgcatatggcaggcggcaggattattatagcaaacccggatagaaatagatagcataacaggctaaatcagcctaactgttttcacctcaaatgctcggaaatcaagggtaaccgctccgtccttaatcgggatttcctccagctcctgctccagcatatcgcaaagataagcccgctcaaattccttcggcagatacacctgtgtgacaacggcggcgcgctccgcttcatacatacgcagtatcatatccccgctgccgtcctccgccggcttcatggtatccagcagaatatttttcttcccgatcccgaaggacatcgggccatcctggcctgccggccttcccggccttactacagggcgcatgttcagctcatatccctgccgcaccgcttcgccctcccggaagcttccttcccaggcatagaaggcataggtaaattcctgtattccgttgtccgcacgcatctgcggacttgccgccgccctcagaagagtcagctccatacagccgtcctccacgctgatgccgtactttccgtcattgagcaccgccgtcccatggccctcatcacaaagcgccgtatatctgtgattgcaaacctcaaaccgatccttatcgtatgtccttgaccggtgcgccggccgttccacaaacccgaactgaatttcatgcctggcgttttccgcatgcacccgtaccggaaaggcggctttcagcaaccgatgcagctcctgccagtcaatccgtgtgtgaaactccagccgcttctgcccggcctcaagccttatgtcctgtgtataagaggagctgccgattttcccggtgatgcgaagaaccgcttccagcccttccgataccttattaagccggatatcccgtgcaccctccagctccatttcccggtagctggcatcgatgtcccacgcgtcaaaatgtctgggcacatccttgaatatccgcagccggttcatcggccccgccgccagctccctgcccgattccttcagtacaaaggaaacaacctctcctctgtgattgataactgcggctaaccattcgttttccatccgccagccattttccgtctgcctcaggagggcagggctgatcaaactgccctcccggacaccgttcttctggtgttcccggtccccttccctgcttccgcaaatcccgttctgcggttctcccttttcctccgcggcggcgctcaacacgacagcgccccccgcgggcagactcaccaatgtctttaacacgccgtctgtatactgcaccggcagccttttcccatcctccgtcacagccccgcggcaaaaggtttccggaaggcttactatcgcctgtctgggaaaagacagggaatttaaaacagtgaccgcagcctctccctccttctcctgaagcagccaggaaagcgcctgctgtgtcatttcccctgcctccttcagtatctgcaaaaaagccgcctgcgcttcctcgcataccctggcaatggaagaacctggcaggatatcatggaactgctggaacaataacagcttccagagtctgtccgcccggggcagatcatagtccattcccctgcgcactgcctgcgcgctccaccactccatttcccgcatcgcaagctcacatgccctgttatacttttttatcctggcctgagaggtataggttcccctgtgagagctgaaataaagctcccccgtatatgtatgcttcgccccacccagtctgtccagaaaacggaaaaattcctccggcgatcccattttcatctttgggcttccctccagatcctgctggcgcagcacatactccacatgatccctcgtggggccgccgcctccgtcaccgtagccgaagggaagcagaaacgcctttaaatcctccttctgcgtcctctccttccatacattccccacctcctgcggatctgtccggtaggtatagctggtgggaaggaaggaaaccaccttcgttccgtccataccctcccagttaaaatagtgatagggaaaccgttccccgtcattgcagcaccagaatattttctgcgtcaccagatacttcacgccgcagcccgccagtatctgaggcagcgccgcggaataaccaaaggtatcaggcagccacaaaacactgctttccacccccagcacctctttataataccgcttcccatggaccagctgcctgatcagggattctccgcccgtcaggttggtatccggctccacccacatggccccgtccgcaatccacctgccctctgcaatcgccctgcgtatcctttcaaacagctgcggataatgaatgcggcacatttcatacaaagccggctgactctgaataaaacgatactccggatattcctccagaagacgcagctgtgcggcaaaggtccgctccgtcttacgcatggtttccgtcgcaggccaaagccatgccagatcaatgtgggcatttcccacagcccagaaaagcggcgctgtagtcccgttcaccgcctccaggatcggccgcagagcttctcttgccttccgatagcaggcagtccgcgcctcctccccctgctcaaaatccactatataggtaaattgcttcagggcctctgccgtctccgccgcccgcagtgaattttcatccagcacagaaagaagcttatacagcgtatccgcatccatatacagctggtaagcctcctccctccagattccgaaggtacaccttcccagcaccctgcggctaccttcctccagactgctccagctgcttccaggaagaaccggcccggtagcgcagtagcccgtctcacaattgggaaaatcctgccccgcacaggtttccatgcagatttgatagcgttcccccgcctctccgcaggctgtgatcgtgttgtccaccatataatgataaggctcctggatccagtccgccctataggtcccaaactccttcccgttaacaaacagacaggattccccgcccggatccagcttcagcacaatcctttttccagccgcccgccccggcagctcaatcgtcccgcgaaaccagcagtactcccagctttttccccaggtaaagcccggccctgccggaaccatccgctcctcctccaaatcctccggcctcagctgttcctttgtcctgaatgccctccaggatatttcccccagctcctcataaaaatccatcttcaacgtccggagccaatgcgccagcctgtcctcccattccccgcttaaaatccccatccttatcacaatctcccctttacggcttcggcgtatgtcccgatagccctgcgaaacatacgccgttatgtcaaaaactcatttaattattggcagtataagaatcatatgccttctgatacagacttatataagtatttacatcatatttttccagggatttcagataggaatcccagtccttttcaacgctcatctcaccggttgcaaactgtgcaatggaggtttttacatactccctgagagaggtctggattgtggtgaactgctccgcatccgcttcgtcctccaggaacaggttcttaggcagatattccggatagaaataaggaattacctttgccgtctcatcaaacaggcgcgcctcataggaatccggcacatacatgtcttccggcctgggggacatggaagcgcggaactcagccagctggttcatcaggcctgaccagaaggtattcttctgatactcatcatcctcattggaggtaaaaccgggtttaatccagtaaatagcttccgttccttccaggatggattccgtgggagcctccagcttgccccagtaactgccttccttaccgtacatctgcaccatggaggactcgtcgcccatcaggaaatcgcctaccttgaaggccgcttccttattttcacacttatcggtaataaaccagctgaagccgtccgtcatatccacataatccttatgcagctgccatcttgcgccgttcggtccctctacgggtaccatggccgctgtcacttcattcagatgtgcatcctccaaatcgattcccattgcaaaatggtctgcggtatagccgaataccaggtttttgtcggaacggattacctgctgcatctggtcggagctttgggtaaagcaggtagggtcaatcagtcccagggaataaagctcattcaggtaagccagcccctgcttaaactcttcggtgttacaggagaaaacaacctttccatcctccacatgggataaggtttccttatcacagggtacgaaggaattcagaaggtaccactccagctggcagtcccagtccttgctgcccgacagcgggatttcatccgctttgccgttgccgttgtaatcgctgttctttactgcaaggagcacttccttcagttcttcagttgtttcaggctcctttaaccccagggattccagccattcggtgttataccagagcttgggataggcctggcagtgatagcactcattcgctgttacaaagccgtaaatatttccatcaggcgcataggagagctgctcatactgcggcctggcctcaaacagcctcttaatgttatccccgtactgatcaatcagctcattaatcgggacaaaaattccttccttggcaaacttcaccatcttctgtttgttcatgccatagcagataacatccggataatccccgctggaaagcataaggttcagcttggtatccgcatcccctttatcggagggaagctggacaaattcaatgtttactcccgtattatcctcaatatacttgatggcataattgttgtcggaatactctcccttttcattcatctgcacggctaccgtaatggtaggacgttcctccccgcctgcggcgccttcgcctccctcagctgtccctgaagcctggccggctgctgtgctcccgccgcagccggtaagaagcagtgcgcaggtaagtcctgcagccataagtctggttcccaaatttttgcgtttcatacgctacctccctgataaattaatatgtttatgattaaccctgcgggggataaaaacattatccgtttttccgcgggcaaagcatctaaagtaacccgtacaatcccctgtatccggcccatcccgatacccggattatactccgcttcagctttatttttccccggttctctaccccttgatggaacccatcataattccctttacaaaatgcttctggatcaaaggatacaaaagcagtaccggaacagaggataccacgatcagggaatactgaagcagcgtctttaattcctgccggttcatctgctctgccagattcatgttaatgccgacgctgtcgctcattaccagaatattcctcagaatcatctgcagcggctgcctggaggaatcattcagataaagcaggcctgagaagaaatcattccatttgcccactgcatacaaaagaaccataaccgcaataatcggtttagaaagcggcagcaccatgctcgtaaaatatttccagtcggtgcagccgtcaatggaagcggattcgtaaatctccagcggtatcgaactctggatataggtcttggtcagaatcacgttccacacgcccatagcggaaggaatgaccatcgcccagaaggtatctatcagatgaagcttgctgaccaccagataggtgggaatcataccgccgctgaaaaacatggtcaccgtaaaaaggaacatcaccggccccctgattttcaaatcaaccctggacagcgggtacgctgcaaacagcgtcagcgtgacgctgataaccgttcccaccagcgtatactccaccgaattaataaagccccgcagaatactgggcgactgaaaaatagcctgatatcccaccagtgaaaaatcaaccggccataaaagcacctttccggcggataccgcgctgggatcactgaaggaggatgccaggacaaacatcaacggcaccagtatggctaccataataatcagcagcagagcccacacggaaccagtcaggatccgatccgggacactatgataaagcttgaccttgtttttattcttttttgccttattcaaactcatttccccgcctcctaccaaagacttgtttcgccgaacttctgtgaaagcttgttggctgtaaacaagagtataaagttaactaccgaattgaacaatcccacagccgtggcgaaggaatactgcagatccttcataccccgtttaaacacatacgtggagatgatttcggaaaccggcagattcaatgtattctgcatcaggaaaattttatcaaagccaactcccataatgcttccgattgccataataagctgtatggtaataatcggcttcagcgccggaagctccacgattttgattctctgcagccggttcgccccgtctatcagcgaagcctctacaagcgactggtccacgtttcccaatgccgcgatataaataatggcggaaaatcctgtggtctgccatacacccgaccacacataaatatggcggaaataggaaacccttcccataaagtccacccggttcagccccaggtattccagcacggtatttacaataccaatgttcaggtgcagacactgcagcacaatgccaaccaaaactaccgtagaaataaagtagggcgcatatgtcaccgtctgcatgaatttcttaaaccggtcatttcctataatatgtaatgcaagcgcaaggataatcggcgccgggaacgtcaccaccagctgataaatactgataatcaatgtatttttcaaaagcattccgatatcagggctgctgaaaaactgtttgaaatacttcagcccgacccaatcgctcccaagaatccccttcctgaaggaataatccttaaaagcaattacaattcctcccatcggcacatagcagaatataatgatatacaaaaccggcaatgacagcatcagatacagctgccatcttttccgaaaatcctgtttcagattccacttctctcttttcttctttcccatctttgcccttcccttcttcctaagatataagacacctgttacaggcaattcaggctgtcatatccaaaaccgttatatttaatcaaacctgtatttacctgtttgtttgaaggataaatagtatcatcttcttttccaagaaaatattattgtgatccctgccaattcttatgaaaacaggggaaaggattcttgtgaaaagagcttttccttgtgttttacggaaaaattgtcctgctgcctccttaccgccggacgatctgataagcttcaaagaatcaccatactctgtcattccagattttcaatagccccaactatgctcatcccggcaattttcctcaaagggatgcaggtcgccgccagacaggctgtgattgaaagagccgtggcctgaaccatcggaagaaagggcaaaggcgccaggctaagttcctcctgtgccgccgcctgtacaaaaacagtacagatatatccggcggcgcatccgagaatggcggcgatcaggccgtaataaacaccttcccagagaaaggtccggtaaaggcttcccacgctcatgccgatagcacgctgtgtcccgatttcattgatccttgtgtggatattggtatagacggtgttaacgatgttaagcagcccaatcagtcctataaaaagtatcagcccccaggcgagcattttaatctgggcgaagctttcctccagctgtttgtccgtctgctcaaaggagagacagctggttcccggtatccggcgggacagctcctccagcatggtgtcgaatgcttttctgtccgcatcctttttcaaaacaggaagtatctcctcatagacgcttttgcctgtaagctctgtgtacaggccattgtttacaatcatctgaacgccgttgacaaatccgctgcttccgatgctgatatagccgccgtaatcgtcaagcacatacagaactgggatttcctttcccccggcgtggatggtttcccctgcccggatgccggttctgggaacctgcttcccgtcataggcaaaagggacagggttgcggattacgcagccctcaccggctttcaaagcctccagctgttcttttgtaagctgcgctttgaaaaatttatccatatacagcccgctgagtccggcgacctgaaaggtttcgcctggctgcagggaaaaatccagggccatctcttctattctgttttcatcgttctgcaagtatatggaaagctgcaaagcggcggcggcctctacattttcattttgttccagctcttccaatatctccggagtaaagccaacggtttcattgatcacggaataatcccccagatgcgcctcctccaatgagcctgccgtattcagcagggaaacaaagctttgcagggcaataaaaacagtaatgctcataaccagggataatatggtaatggccgtccgccccctgttccttttcaggttgagacgggcataataagcttcaaagctcctgatccgtttcaccttccgtcctctgcgcctgactctggtatcggtatgggatatcgccacgacaggtggcacattcgcagccgaccgggcggcaggcagggccgcaatcaaagcaaagcctaaagtgataacggcgctcagcgcaaggaaaaggcctttcccgccgctgttttctgcaatcagccgtttcagctgtgcggtatcgttcactaaaaaaatgtccggtgacagcattccggccgcggcggacagaatcccctctgccgaaaacatccccaacagcattccggcggggattccgccaatacataacaggaggatttcggtggtgacgatggcgtagagctgtcctttttctcctcccatggcccgcagcgtcccgaactgtctgatccgtttggatacggcgatcttcagaatgttataaatgaccagccccgctgccagcaggaccaacgtccccgccagaaggcccgccaccgtcagaaatggaaagccctgatccgaaacctccgtatcggcggcctcttcatcatagggtatccccaaagccctgagatacgtcacattatagattgtgtccagctcatggacatgaagacgtgaaaccagatcatccatagtatcctgaaaggcgcccttttcagaggtgcggatgtccacaagatagtaaatataggaatccggcaggacctgttccgccgttccctcacccacaatgccgcagacgattcccgctgcataccccatataattgctctcagtaatccctgtgaggataaaattagcctgatacgtcaattcttctgtttcaacgccatgccggagcgtttttgccgccgtgagggtaatggtatcgcccaccttgccctcaacccccatcagacgcagcgcatcctccggcagcgcgatttccatcgcccgttccggcagccttccttcccgaagccgcgtaaaggatggaaaaatctccccgctgccatcccggaactcaatcagatccagatgaagcgccctgctcaattccaccgtgcccaggcttacggacacccccgtataagaaagcctgggatcgttttgcagagcctccacctgctcctcattcatctgcacaaacgtcgcataacggtcgcctccaagcgcgatggcctgctgctgccgcatggcagaaagaacgccggcggactgcccgatcactgttgtcatcgccgtggacaggatgattgcagccagaattaaaaaagaggtcattttctgtgccagaagctctttaaaagccagtgtgcgatatgatttcatcctgccgtcacctccgaaagcacgccgtctgtgatatggaactgccgttttgccatccgcgctatacggctgtcgtgggtaatgattacgagggatttatccatatcctcccagatattcttcaatacctccatgacctcactgccgctgcggttatccaggttgcctgtcggctcgtcggcaaaaataatgtctggctgcgcaatcagcgcccgtgcaatggccacccgctgctgctgcccgccggacagctcccccggcagatgcgtcaggcggccgccaagccccaggacatcggtgagccgctttacataggcttcctccggctgctttttatccagcaggaggggcatgataatattttccctggccgtcagcaccgggagcaggttaaactgctggaatacaaaaccgatgcgcctgcgccggaaggcggacagctccctgtcgcccatgctgtaaatatccctgccatcgtaagtcaggctgcccgaggacggcctgtccagcccggaaagcaggtggagcagcgtgctcttcccgcttcccgacggccccattatggaaatgaattccttcgaggcgatctgtaaatccgctttatccagagccaccacccggttctcgccgctgccgtaaatctttgtcagtccctttgccgttatgttcataaaaaaacactctccttttccaagtaataaggagagtgtagcgcatggatctcaagaaacgctcaaggctatttattaatttgaaaaaccgccgttgcggccgctccatggccctgtacatttttaagcgtcagcgttccgccatgtttcatgcagatcatccgacagacatacagtcccatgccaaagtgctccgcatcttccttcattttcccgaagggcttcggcccgtcctgcacgagagcgtcgggatagccggggccgtcatcccggacagataacgtaaggaaggaatcccggataccgagacggatggctatctcactttccgcaaagcgcgcggcattcccaagcaggttctccgccactgtcagaaacaatccgtaatccagaagcaccgtacctgtcccggactgctgtcccggggcagagtcatatatctcgggatgctgccccggggcagaattatatatctcggactgctgccccgggacggtatctgccgccttttccccagcgcagacagacacccgcagtttcggagccagcagcctcgccgtttcttccagctcctcaagcagtacagcacaggatacttcctttttgcagaccggcatttgctccagccgctggatgctgcccatcacctccacatactgctcaatgcgcagcgtatagctctcaagccgggaaagcgcctgttcgtccgccgtcccctgccgcagctgcttcacggtacccttcaggaccgttacaggattgcggagatcgtgggaaaaggccgcgttcagccgctttcgttcctccgcctgcctccaaagctcctgatttgatttcaataattctgctctcatggtttcaaacgccgcacacagctgccccagctcatcgtccgacaccaccggaatggcaaaatccaaatcctgcttcctgatgcgcagcacaccttcctgtaatatcataatcggcgccctgcatttcaggcggtagaacaaggcccccgcaccggcaaggccgcagaccggaaaaagaatacaggaaaaaatctggatataccccaacgccgccgacaccgccctctgttcccccgtcggttcctccaaataagttatcatcccatccgggccaaacgcaatgcctccggcgggaaaggctgaacggagcgcgctgcagccagcccagaccgcggccgtcagaagcagggagcctaaaagacacatgacggccaacaggaaaaaggccttctttagccccatattttttatccgttccacttatatccgcacccccagaccgtttcaatataattatgaagcgtatgcgcgcccagcttcgcccggattttcctgatgtgctccataacggtatcgctgctgccttcaccgtcaataccccagacagtttcatagatacgttccctcccgaaaacctgtccctcattcagagaaagaagctccacgatatcaaactccctttttgacagggccaccggttcacagcccgccgcaaccgtccgggctgaataatcaatagccagctcaccgaagaaacggaccgtcatacatttctcccgtcgtttttcccgccgcagatgtgcgtccactctggctcccagttcctccaaatcaaagggtttcacgatataatcatctgccccggcctgaaaaccgctgattttatccgcagactccacccgcgccgtcagaaataaaatgggacagctgatatattcccttagcctccggcaaaccgcaaggccatccatttcaggcatgttgatgtcaagaagaataagcttcggattccgggcggccttttccagcgcttctttgccgctgtatgcggtcaggacctcatatcgcgcctgaaaataactcttcatcatatctactatgccgtactcgtcatccacgatcaatattttctgtttcatcaccttttctcccatttatttctatcctattatgttaagtataaacggtaattctcaagattttcccaaaatggggagagaaaattaattactgtttttccgtattccctccttctgttttccctcctataacatcctccaggaaaaccggccggtatccgttttggtggagaatgcgcagggcggaatgaagcttctcctcaaagtccggctgccaggcagcataatcttcataaaaatactgctcatgggtcatcaactggataaacggcgtatgctgcccccgttccacattctgaattatgttttcaataatagcttccgtctcgccgagcccatgctggttcagaatgatatcgttgtgcgcgaaggtcaggcccgtctgtgcatcatatacgaattctcccctgcgaagtttttccgcctcatccggcgaaagatgataatgaagggcttcccttcccgttttttcataaaacatgccaatcaggcccctgataccgtgattcccaagcatggaacagccctccggggacgctgccgcataatgtatggtagtggtgcgggccacagcgtccggtcctgcaattcggttaagctgtgacatgacatcttcaaaatcgcgctccaaaagcgctgcatcatcttcataaggatatgggggatcattatggcgcgcatgaaaagaaaatttaagccatccggaattttcttttaattcctttttataagtatcgggaacatcagccagtgaaaaacttccgggataatagctgtagaacatattgagctgaaacttgcagccaaattctttatgctgacggaagagcatcgccagataagggctctgtaataaagacggttccttccgccggcaggcgttttccataaaacggatgttatcatcaagcgtaaaacaatatattttttccataaatatgctccttttattcgttggaaatttcaatgactgccggaatatggattgtgaccaccgtcccggcgcccgggacgcttttgcaggataatccatattcgtatccataggctatctttaaacggtcaataatatttttaacaccatatccgcccggctcccgtgcgatttcacccggtggagaagaaaataccgtatcggctttttcctgtggcattccaattccatcatcggccacctctatatatacgtcttcccctttccggtatccatgtaccgtaatggtccccgttccgtcctcccgttcataaattccatggatcgctgcattttcaatgattggctggagcactatttttataatgtacagattttcgatttcaggggaaatatcccatctggtttgaatccggttttcaaagcgtgcattctggatcctcaggtacatctttgcatgcaggacttcatcgcggacaggaatcctgtcttttcccctgctcagtgaaattttataaaaggtggccagggaggtggccacacctgcgatttccggcacggccttctggatcgccatgcagttaatggtatccagcgtattatagaggaaatgggggttaatctgtgcctggagcgctttcagctccagattcttaatttcaaaaccgtaccggattttttcctccatcagctgttggatacgccccatcatatggtcgaaatgcagaatgagctgtccgatttcatcttttccctcgctgttgaaacggacctccacatctccatcctctaccttctgcattgtttccgacagctgccatatacggcggagcatatggttgctcaaatagagtgcaacggcgtaggcagcccctgcaaccgccgccatgatcccaatcatttcattgcgcaaagcccggcccacggaataaatatccgtataagggaccaccgaaacgagcgtccatccggtaggcgggagcgtggcgctgtaagtatagcagggtattccgtctaattcaatggtattccaggtatcctgggcggattgtgaaagggaagccccgatatcctccggcagattctggccggctccattttcagaggataaaacagtgttatccccggaaagcagaagcatgaagccattctgtgtgatggcggtccggttaagcgcctgttccagcatgctttttgataaatccacacgaaggacggcaagaggcgtagtcagggtatctggatcatatatcaccctcatacaggaaaaataagactgctcccgggagggttgatctgcaaaatccagaggcgtgtaccatcgattggaaggcgcttgccacagttttttataccagtttgtatccgtcgccgaatccaatggtaaaatgcgggtattctcattggaatacagatagacatttttcacatacagacggatgttttccacaccagaaagctgcttcagctgattaaaggagattgccagcgcattggagtcctccagctgataaataacaggatagtcctggggatcagtagacgccattttataaatcatgtcatcataggtgagcagctccgtaacattgactaccttctcgatgcgtgactgcacggcggtaaaggtttcctcaaaggtcttgcccgccgccaaaaaggtctgctcctgaattacagagctgatgcgccgcgtggcgtaaagggtaaaaaaacaaaagggcaggatcagcaccatgaaaaaaataagcaccatttttacacgtaggcttgcatcctgaatgatgtatctgaaaatatattttaatttattttgcttcatgatgacgctccctatattcccgcggggaaatacctgtttcttttgtgaataccctggtaaaatatttcccgtttgtatatccaacacacgcccctacctcgtacagctttctggcaggctccttaagcagctcacacgcccgctcaatgcgggctttcgtgagcgcggcattgattgtctgcccggtttttttcttgtaaacggcgcacagatagctggtgttaaaattcagatcccgtgcgatcccgtccacagtaaccgtactttccgtaaagtgtgcctggatatacccgtttacctgagataccggatcgaaatccctttccctgatttcttcatataaaagttcagcaattcgtaaaagttcattttccagatcctttagacattccatctgtgcagtcatatatacaaaagcaccgccggcagcctgtgctttagccgcgccatggaattcagcggcgctttcaagcaggaggcctaactgggaatatacattccgtacatagtccggcggcgtaccttcacacctgcggatccgggcgcacagggaatgcattgcaagcagcagtgcagtttcatcacttgtcccaagcaatgccctgatctggcttaaatccgttttggtaagcgtaaaaacctctttgttcagtaaagctgcctttgtatccccatggtaaaaaaacagctcaggattcttctgtgcctcttcccggaggcacagacagacaagctgccgcaccatggatgaaatctccggtaaatcaagaggtttctcaatatacccgtcagcatgtaaatggatggcgcccttcaggtattccttatcagtatagccgctcaaaaaaacaaggcggctgccagggaactgttcccggatgagctgcgcaaattccatgccccccatatgcggcattttaatatcagttatcacgatggaaggctgcactttttccgcaagctccagcgcgcatacgccgttttccgcaaggtatacggcatctgcgcccagttcttcccaatttatgtaatttgccagagtatcccgcaccagtttttcatcatctacaatcaaaacggatatcatagcagatttcccctttcattttatgaacacattatacatctgtttttatagccgcacaaatataatcaggcattatgacgaaacagcaaaattctgtgttcctttccaaattttgttccgttgaaatcgaaattcaaaaactgttatgcttaatacagaaaaggaggagggcggatgaaaaaaacacatttgctgttgaacgatttaaagaaaaaccgcattaagtggctgatgcttgttccggcggcggttgcagtaatcctgatgtgctatatcccgatgacaggcatcgtgcttgcttttaaagaattcaattaccaggacggcatctttggaagtccctggatcggcctggcgaatttcagttatttttttaaaagcggcaaagcctggtctattacacgcaatacaatcctgtacaacctggcctttctggctgttaatacttttttccagattacctgtgccattttattatcagaactggcgcacaagcatttcaaacgcatcacgcagtcattgatgtttttgccttattttatttcatgggttgtggtcggcgcttttgtatacaatatgtttaattatgaattcggcgctgtaaataccctgctgcgtcagctggggctgcacagtgttgatatttattccaatccgaaagcatggattcctatcctgatcggcgcaagccttttaaaaaacctgggctatggtactgtgatgtatctggcaagtgtggtgaatatcgatgatcagctttacgaggcggcggatgtggacggagccacaatgtggcagaaaatatggaacattacgcttccgtgcatccggccgacaatggtcattctgatactgctttccatcggcaccattatgaaaggggatttccagatgttctggcaggtgacgggcaacaaccctatgacgctggaggttacggatgtgattgacacgtatgtgacacgcagcctgatgtatttgcaggaattcggtatgacaagcgcggcaggcctgtatcagtccgtattttcctttatcctgattatgctcgccaattatgcggtcaaaaaagtagaacccgactatacactcttctgaaaggagaaagcaatggaaacacagaccggttccaatagaaaactcagcagcgaccggagagtattcaatatcatcagtgtggtattgctttcgctgcttaccctgttttgtactctcccgttttggcttatcctctcaggctccttcaccagccaggattcgatcctgacggatggataccgcctgcttccgaaaatattttccctggaagcatatcagtttctgttcaaagcgccggaagatatgctgcatgcttatggggtcacgatttttgtgactgccgttggtacattctccagcatgatagttacgagcatggctgcctatgtgctttcaagcagagattttacataccgtaataccgtttcctttttcttctattttacaacggttttcggaggcggccttgtaccatggtatattttcaatatgaaatatcttcactttaaaaacaattatatttccctgattctgcctacgttagtcaatgtcacctacctgctgatactcaaaagctatatggccaacatcccggaggcagttttcgaatcggcgcggctggacggcgccaatgactggacaatataccgccgcatcgcgcttcctttaagcaaagccggccttgctacggtgggactgtttattgcattgaactattggaatgactggtatgcagccatgctctatattgatgatgacagaatgtatcctttgcagtattatttgaacgatattctcaacaaaagccagggaatgatgaatgccgccgcccgtgcgggaattccatcctcacaggttcccagcgaacctgtgaagcttgcgatgactgtggtggctacaggtcctattgtcctgctgtatccatttttacaaaagtatttcgttaaaggggttactatcggggccgtaaagggatgagtgccgccccggtgaaaaattaattaaggagggttacaaatgagaagaaactctaaaattcttgcaatgtttctggtactgataatgcttgggggcatgtttttatccgcatgcggccaaaagcccgcgccgccggcagacaccgctccggctgctgcgccgtccgaagagccggacagtaaagcggctgttgcggagacggaaggaacagaagccattgatacttcccaggaagtgaagcttgtcatgtacctgttaggggagcggacgccggattttgacaaggtatttgaccggattaatgagaagctgaaagaaaaaatcaatgcgaccatcgaagttaaattcatgggatggggagaatgggagcagaaatatcccctggtatttgcatccggtgaggactttgacctgatttactccgcagactgggccatgtacaatacccaggcaagcaaacagggattctatgaaatcacgaaggatgagcttgaaaaatatgctcccctgaccgctgaaagcatttatgaagatgcctgggaacaggctaaagtagacgggaaggtctatatgcttcccatgaattataaagagctcactgcctttgtattccttgtacgcggtgatcttatggaaaaatatgggattgagaaagtagagacgatggacgatgttgaaaactatctggatcagatcgcgaaaaatgaaccgtccctgattcctctggatatcggctccgacttcgatgcgcgtatgctttatgatctgttctggcagaaggaaacagtgaaccgtctggaaaaaatcaatcccatgcagctgatgggatataccaaaaaaggggacgataccgtcaccgtattcaatgagacggaggatcccgctttcctgactgccgtagaaaagcttcaggattggaaaaaccgcggtttctggagtaagagcgcggtggtaaatacacagaacaacaaagagagctttgcggcaggaaaaagcgccgctgcactgatgaacatcaataacgcgaaaagtgaatatacaaataatacccttgcgcaccccgaatgggatatccgtgtggtggacgcacagggagatgtccctgctattgtacagtcgtatcttgcaaatggcatgtgcattttctcaaagtccaaaaaccctgagcgtgcactcatggcgctggatctgctgcgcaatgacgaagagcttcatgaccttttcagctatgggattgaaggagagcattacattgaccttggcaatggaaagattgaattaacggaaaataacagcaattatccctacgacaccaacggcaactggggcatccgaaatgacaaatactggaaatcagtggaaggcggaatccccaattatgacaaattatatgacaagtggataaaaacagcgcaggcaggggaattcgcagcatttacctttaacaatgaaagtgtgaaaaatcaggttgcagctatgaatgatatttataacaccaatatcaaactgctctaccttggctttacagatgatccccaaaaggacataaaagcaacacaggaaaagctgaaggccgccggagccgatgaggtttattcggaaatgacacggcaggcaaaggaatggaaggattctttgcaggaataggcggcagtatatgatcttattggaaacagtctctgtccggcaaagactcaggccataaccaaaacggtccgcggacaaagcgccgcggaccgttttcttatccgcaatgcattgtccctatactctccgggcagcttcccataccatccatccgtgcaatgtcggccgcccattattttttgggagccgtttttttcaacaggaacagacggttcagtccctcctgccacggatacctgaactccatatagcgttccacgcggccataagaggccagtatccttttccagtgttccgttgtttcctgatgaagccggagaaccccgtcttcctcatacagatgatcccccattttctgataatcaaacctttttaagtccttgggggaataaaagggattcagtttaatgaaccagtaccctccgggggcaagaacacgatccaggttccgcaggacgctctcgtccgccttctttggcatcacgtccagaacatttgacaatatgactccgtcaaattcaccggccccaaagccggccaacatactgctgtttcccgtaaaaaaatgcaggccccgatatccgctcatatttgccgtcttccttgcaaattcaatcccccgttccgcctcatcgattccaacgccttttttccccggaaaattctggatatattgaaaaataatatcccctgttccgcatccaaaatccagtacataactggttttttcgccgaattcccgcagacagttatcaaagcccggttccactgccaggtccgtattcctcaaatccactgcctgatattctgagtagatttcattccatatacctgtttttcttccatatgattccatttatcccctttccgtttctgtttcaacctgcattcccggcaacacctgatactttataatagttttttaatatcaccttctttcctcatatataggacaccatcaaaacaaagcgaggagtcagatcctctgcccctcgccgtttaatcatattatatggttattccatggagatgtatttctctttcttatctgactacgttgtaccacttgttaccggcgctgtcaatatacatctgcattactccaaattatctttgtttctcttgctctccctccaatcagcatccacgggcggccaatccttttcccgggttaaataaatccggtctatccgaagccctgattttctgccaataacagatagaacatgtacaccggcatccatttccataacagccgccgcgcgccagtgccacctttgcttcatgctataggtaaaaaatccgccatgggaagaaaaggttctttccgcgtctagtaccataccatccagcgcaaaatagcaggaatcgctgtcggtatcttcaaatttcatcagaagccatacaaaatagtttccggcatcccgtatcctgatgcgatagtgcattcccggagcttcctgcggattttcccaatatctaccccttccttctatcatcatggcaaggcctgaacggccgtccgtttctgactgggtgtggctccagcaatattttccattcgggacagaaggcgtcaaatatgcattctctgaattttccaacgcatactctgcctcaattgccacaactccatcctgttcctcaaacagtccgtttccaaattcctgaaatacatctttcgtaccatccgcccgggttctgtacttaatatttcccaaccgattctctttttcatcgctgcgcgcatacagtctctctgttttccagaaatccggcgccgcatacaacatgggaagcagcagctccttatctgcagggctgccataaagttcccgccaaaaggctgcctgaacttctctggcactttccggcatcctatcgtcttcggcttctttccattttgtcccatcaaaaaaagcgctctccaacgggccgaaattgctttccttccgtctacgggtataaatgaccaatttatgcagcgttacgtattgatccacaggatatattttcaatctgtgcagacctgcaggcagccagggaagcatagtgtaaagcttttccccatcattcataaccgcctctttccagctgcctttccattcgtccactgttttagtttcaataattaccggccggccgttatccactccaatggcaaacctcaccttcccgacaggattgagcgtgaggaaccggtgtatttccaggagaaaagctccgctgctttccaggaaaaaagaataatccagataacagctgtccattatttttaaattctcaccggataccgccgccatatcttcaccggcttccaggaatgcctccatagcgcttccccagcctcttcccaaatgttttatttttctccagcaggcctctttcgaacacacgctttccgcatatccctctgcaggaatggaaatacagccgtcagcttccgcgtagaaaggctccgtatatgaataagccgcctccttcaaagcctgtacctcaatttcgaaccggccgccatcttccccggtaatgacgatcttccccgttcttccttttgcaaaggatgcggcacgttcactttcccggatatggacgctcagcattttttccacagcagccctgccttccttttcactgatttccagccaatccggaatctctgcccgaaagccaaccgtcccgcatcctttattataaaggataattgttttctctttgcttccatgtggatgaaagataaatttatcctcccacatagctccaagagacgcggctccaatcaccagagcaggtttggccgccggatacagtaccgtcggaggcggtgtaaaactttccggggtcaaaataccttcccattttccattctgcatcacatgattataataatacagcagctcctgctttcttcgatccatctgccttgacttttccagatactcatccgccgcctgcattcctccccactcccagaaaagcctgcttctgtccgcatagtaaaaagaagcatttatatagtaggaagcctgcagcttcatgagaaacaattcaaaaaaggcatctctttcctccgcaggaagacactgatagatttcacccgccctgtccgacaattcctttaggctgtctaacctgcgcttcgcctcattcccataggcagcctgcgaaaatttatccgactgcagatgctccggcttacatacgttattaagctgggcaaaccgattataaatatctgctgccgccacgccgaaatctccggaaaaatttcggttaatccaacaggaaataaactggcttacatcctttgtctctccttccttccggccggcttcccaaccataacgcaggaaaaattccgtatctatttccaggggcttcagcgctcccacattcagcacccacatcttcctgatgccctgctcccagcattttttcagttcatttcccgtctgcgccagaggaatggagttgaaaaaaagataactcataccaggggacgcccagtaggatgaatgataatacagaccatttccgcctctccgcttccgttcctctttttggggatagcgcctcatatatccaaagttatcatccacccaaatcaaggttacatcctcggggatttgcaggccgccgtcatacaaatccaggacctctttatacgggataaaggtctgcactgccttctttcctttatcttcacccaatacctctgtcaggatctgcctctgatcgcaaatcaccttctccagcaatttaatcttcttttccgttctttcttgcggtgtcagggaagcgtcctgatcaatggtttcagttacaaaccctgaatcatggattccgcgcataccgacggtatagcacacttcataatcctggttcatctccacgctttccgcccaatactccttgattatttctctgtttttatcagggagtgaataatcatatctgatattctcatatccctttttcttcagccagggcgtccactcattctgattactgcgaagtaacatatcacaatgggaagttcccacaataatccccattttctcagcaagctttccgttttcaggatcaccgttaaagtaattcacatgcatggcaggccatatataattcgcttttaacctgagcagcagttcaaaaatatgagcataggttaccggtcctatggtatcatcttccgtatgcagctttgaccatgcctccaattcctcttcgtcattcaggaaaattcctctgtaaggcacatcaggccagtccgctttgctgtaatcctttgaaaaaataaaccgttccttttttctgaccggaacatcagcccagaaataccacggggaaatccccagctgttcgcttaaatcataaataccaaaaacggttcctctccgatccgcccccacaatataaaaggaactgccataaatctgatgcagataagcctcccagcgtcccttcccctgaccgtccataatcctttccagcgccggaagcatttcctccggaatattctgtaaagaacagggagtatccatagtgataataattatctccgtctcattttccgagacagaattcccaaagctgcttcccaattccacgttacagtcacaaacttttcggatatcctccgccagctttgaaactgcacattttactgcgctgttttctttttcagaataagtaatccttacttttttccctgtttccagcaggacaaaatctccgtctctttccattttctttcctctgcgatcagcccttcacggcgccaatcatcacacccttttcaaaatatttctgaatgaacggatagatacacaataccggcatcgtggacacaatgatcacggcaaacttaatctgatccgcatactgctgggcatagcttccttctcccatgcccgtcgtccctgccatagcctgattactgatcagtatatttctcagaaccgtctgcagtggctgatattcatcccggttcagataaagcagtgcagtgaagaaatcattccagtgtcccaccgcataatatagtgttattacggaaataaccgcttttgacaaaggaaggacaatcgcggaaaaatatttgaaatgggagcatccatccagctctgccgcttcctgcagctcatttggaatggaattttcaaaaaaggtccttgtaataatcacgttatagacactcaccgctcccataacaatcataattaaaggtgagttagtaagatgcagggatttaaccagcatatatgtaggtaccatgcctccgccgaagtacatggtgatgacaaaaagcgtcatcacaaaacggcgcgcccgaaacctgctctgcgccagcacatatgctgccggaagggtcaccgcaagattcagcagcgttccgcataccgtatacaaaatcgtatttctgtatcccacccacaaatccatgcgctccaggattttccgatatccaaagaaattaatatctttcgggaacagggttacaagcccctgatttaccatattggaattactgaaggaggcaatcactataaagtacatggggtacaatactatcaccaatgcagcaactgcaattgccgttacaaaaatataaaaaatacggtctgacagactctgctgcattttctttccaactgctttcatgttctattcctcctacatcaggctgatatctgcggccttcttcgataccatattggcaatcatcagaaaagcaaaatttataactgtattaaagagccctactgcagagccaaaactgaattgccccgactgtacgcccacattaaaaacataagttgaaataacctctgataccggcaggttcatatcgttctgcattaaaaatactttttcgaagcccacacttaatacacgtcccatattcataatcagcaaaataacaatagtggggacaagcgccggcagctccacatggattacctgctgccagcggttggcaccgtccacctttgcggcatcatacagctgcccgtccactgaggagagtgccgcaatgaagataatgctgttccagccggccgactgccagattccggacaaaacatagaccggtacgaaagcactgggtgtacccagaaggttgatggaaggtggtatcagatgcatgcttttcaacagaccgctgaccacaccggtagaaggggaaagcagtatctggagtatggcaaccataacgaccgttgaaataaaatagggcatataaaccgcggtctgcaccacctttttcagtttctgctgtcttaacgagtttactacaagcgccagcagtatcggcgccggaaatccacatatcaaagtaaaaaaggaaataataaaggtattccgaagcgttgtccagaacatggggctttcaaaatattgtatgaaatatttgaagcctacccagtcccctccggttaaccccttggaaaaatcatacttgcgaaatgcaagctggattccatacatgggtccatagcaaaatataataatatagacgatcgccggcaaaatcattatccaaagctgccagtctttttttagaacggacaatatttttcgtcccatagcgtacctccgctgatgcagttttttatagtcctttatctggtaagagccgggaaaactgtttccagatgttttcccggctcctgcattctccggattactccattgatgccagatatcgctcatatgctgcctgtctgatctcaagattctgcgtcaggccgatatcataaacagactgcacataggcatcccattcttcttctatatttcttgaaggttctgtgagccatgcggaataagtctgatccactatattattgatattagcctgtgccatggcaagatcggaattttcatccgtcgtgtaggttatgaatttggacggataagtctcacacttttcctccatcatatccagcgtcgcttccagaggctttctttcctccaggactctctgcatatcttcgcccatagtcagtctgtccttcatatcgtccggaatataataaggactgtaatccgcaaaggaatttgtccacttccaggttcctgcatcaatacttgaatcagcgggaggcagtacggtataggttccgtctccattatcctgaatacatttgtcgacatcattcataccgccgaacagcacctggattcccatatcttccgcataaaaagcatcaataaactttaccgccgcctctttgtttttgcagtttgcactcaaagctaccgtcgcggcattaacagagttattatcggaataatagccccagtaaacctgactttcatcggaatccgcatgaggcttcagtgcgggcatcggcgtatattgatccgccacctccgttccgaatctgtcaccgctttcccagcccagagtgacgccaaccctggccgtttttccttctccgcgggcaagtgactggaatttggaataatcctgtgtgatcacttcctcattaatcaccccctcaccatacagcttctgcagccactgcataaaggttttataacgttcatccacacggtaattctttaccttgccgtcttccacgaaatagccgtcactttcattcatcataggaacgccaaagcaggccagcataaaagtaggaaagccggaaaaatccaaaggtatttcatccgtcgtatcaccattgccgttagggtcgccattcttgaatgcaatcagaacctcttccagctcatccattgttgtggggacctgcagtcccagattgtccagccatgtctggtttatatacagaaccctgtttgttctcggccagaggctcctgtaattagggattccgtaaattccatccttttcatcggtacaaagcacccgcagttcaggatgatcttcaaacattttagctacattaggcattttcccctcatctatgtaaggcgccagattttcaaagagtccgttataggtggcaaaatcagtggtaaccgttgctttcaccagaatatccggaatatcccctcctgcaaacataacgcttttttctgatcccagtctgcagttatctgctgccattccacgtcaactccgttttcttcctccagaagcctcagccattccatttcatttacatcttttgtgagactgtgtttggaaatcaatgctgtaagcttaaccgtttcaccatttgttttctcttctccctgtgttgttgaaacagaagccgcagaagtctcatctcctccgccggaggtatttccgcagccggccagacagcttattcccagacaaccggccagtatccatgctaaccatttttttgctttcactttttctactccctttcctgatacatagtcttaaatcactttaaaattgatgtcgacatcgttgtgagattattatattgaaaaaagggcagcggaaaaatggatcagattttgttttatgtgttattttttctctgtcatcattttctccctgcaggctgtaggcgtcattcccgtttcctctttaaaaaccttggcaaagcgcctggcgtcttcaaagcctaccctctgggagatttcattaatgctcatatcggtattgcagagaagttttttacttttttcaatccgcagctttcttaagtaggtgctgaaattttccccggtgtattctttaaaggtacttgaaaacatggaataattcatggaaacatgattggacacttcagccatatctatggatttaccataattctgccggatatagtcaaccgcacgctgcatttttaaccggcttaccccggtaacctcagcttcattgccggaattcatcttttccggactttccacaccttttgcccggagaatttcttcagcatgccagagaatctttccaagttcctcccgatccaccggcttaagcagataatcaactgcctgaaatctcatcatgcccttcacatattcgaattccgcatatccgctgattgctgctatgaggggccgttcttcctcttccagattttcatatatccactttgaaagctccagcccgctcattaccggcatttttatatctgtcagtacaaggtcatacctgtcctttttcaaacattcaaccgcatccctgccattgcggcactccgttatttcactgtaagggactccgctgttctcaatcatgacataaatcccataccggatcattttttcatcttccaccagtaaaatccttctcatagcatttcctccgcatttattgtaagcactactttcgtataacagttttccatggaaaaaatttcaactccatactgttctccgtacatcagccggattctttcatgaatgttatgcagtccgattccattcgttgaattatcccctccgcctccgttttggattacatcccggaccttcttcagtttatccgcatccatacctttccccatatcggtcatctcaatataagcgcagctgccttttatgtatgccttcagataaatcgttgtgtcttccgccagttcatccagcccgtgggcaatggaattttctgcgatgggctgcaggattaccttgggaaccttcaggtttcttatggaatcctcaacattttcgctgagattgatatagtaatcatatcttatattgcatagcttcagataattttccagataggagatctcttcctgtaaggtaacactgtgactgtcaatctgcagattgtagcgaaacattcttgccaacgccagcagcgcatcggatacattgtaaatccccttgacttccgccatcatcttaatggaatccaaaacattataaaggaaatgggaattgatttgcttttccaggcttctcagctgtgcttcttttatcatgacctccctgtggatgctgatctccatcagctgctttaccctgccgagcatccggttatattccatagcaaccgcattgatttccacctgctccagcctgggaatttccacatccagattcccgttctccacctcccgcatacactcagaaaacacatcaaaatcgtgcagcaaacgcttcacaatactgttgatagctttcagcaaaagggctgtcataagaacctctgtcaccagaattaccataatctgcagcgccatagcctgatactgcttctgcacggaggtaagctgcatgagaaaaatacccgttttttcattcctgctgacggacagcaaaacgggagaatgcttccacatactatgatatatctgaattccctgtgtatcatattcctccagggaagcaagccccatcatatccaccagattatttatggtaatatcaccgaattttccctctgtttccatgcctaaaagcctgttttttgaatcaatcaggaaaacatcctggttctgcatagtactgtaaagttccggtacaatcgccttcatcggcagcattatctcaaaaatgccggtcagctcgctgctgattctaatgggaatgacataagaagccatatttttttcagtataatagtctgaataggtcccgtaggactgtttttccgtcacgttcatataccatgcgccgttataagtaagggagtttctgtcttcataccagagactgtcctccgccctgtccatcctgtacagataggaggagtattccctgagttcaggataatccagatgaatccttgcactctgtacctgactgatgctggtaattaccctgagtgttgataatgtctgctcctgaaacagataccggttatattcccccaggctcccgttaatggccgccttcccaacctcagtaataaaagtggtatccgaccacactgttttagccattaattctatggtattcatctcataattcatatcgtccactctgttctgaagctcttcgtatacctcatcctggattttgcccacctgatttttgtagatgacaggaagtgagatgcatgccagacagatcagaggcagaagggaaaaaagcaggatagaaaacctgaccttttgatgcagtgtcatattcgtgtaatttctctttatcttctttaccatgacattctccattttcagttttagtacggcagttttgccggcagaattaatttgtataatcgactttcactttgtatcataccagaaaactactgctttttcattcaaaatcaatctgtccggccgattcccataaacaggacgtaaactcaggcccggcccgcagataagccggacacagcaaaaaaggaaatacatattggttctaaaacccaaaatatatttcctatattactatcacttttatgctaaaacaaaccacagtaaaaatattctatacaatctacgaatacaatatcataccgccgttttcccggtatccactgttccacaattcctgaaaagacaaataccggtaacctccataggttgtttcttttacataaagctccccctcgaactcttcatatcccgtcaacatgaaccagtgccacagcaaatctttgaatttattattcttatgccgaagcagcagatacggaatcgggaacttactgtcaatctgattctttaccacctgcattgcttcctgtaccggattggaatctgagtaagcacccaactgcaaatccgtattgccaatatcccgaagatacctccccattccatccacatagatatccagccgatcgattcctttcaaccttggccgcagatatggcttcatcaacatggaaaaatccagataatcactcttattaagatttttaatatcaaacggatacagcttcttcttcacacctactttttccattgaaatacagctgtcacaagccgcggcggcagcacatccgcccatatgcatccaataatcccgaaaccagtcctgattcccgccaaatgaattttctatataaaaatactccaattcctttttcatacatgtccgctcctgttcctgtataaacaagcttccgggttcctcattttcctgccattccttcatgatatccagagggaagcagtcctctacgacaaacttattatacaacgaaaaggacctgagtgacagactttaccatatcttttagcctgccctcaactgcctgaaaacatcctttcaatacaatttcttttatgctgccgcagtcccgtccctcgtcagagcgtcggttgtatcaatcaggactaccagcatatttttcgagattataccaaatatatggaccaattgccgcttaattatttaatttactaaaatgatgaaaaaatcgggaccaggctatcttccaaatagcgcctatgtgaacaaaatcgtctatgtacagtatttctttttttgtttattaaccactgaaggcagcccgaacataagatatgtagcttctcacgtccgggctgcttttcgaaataataaaagttcgggggccctaccgtataataaaatatcagcagacaggtcaggggcttactgacggcttcaaaaaatgcagccgccttttatacatataataatctcctggggtatagttttttattaaatatatagtctattttaaaatttgttgtggtaaatccggattttccgaaaagtgcttcagtattacaatatcctcacaatccgaagtatttgttatccttacgcctctttccgcagcactctgtgtaacaaaaaattcgtcattggtaagcccaccataccgaatcatctgcggtgtctccagcctccatttcccaaaggtaccgtttccctgaagtgcaatcattccatagggtgcatgatccacaattactacagactgcccaggaaaaactgtaagccgtttagcacagaccgttttacatttataacaaatccactcttcccgatagcctcttcttttcatttcttcttcagaagataccgggaagggtttcataaaatgatgcctgtggaactcaggatccgtattaagttcccagtcaatgacatccagcagatattcataatcccctcttttatcttcaggacaattcttccatagcaaatcttcttccagtacctggccattcataagtacggactgatacatggcatatacgtccgaggcaaactgaggttcatacgtacaaagacttcccggcgcatgcattactcccggtggtacatcataaccggtatccagtaccagtttatatgcggtggataaatccagtattttattatctcctcttgcaaaatttttcagagcatccaacacttcctgttttgttgtttcgggccggaatccaaaaaaagtaaaagggaattcacccgcatgattattcaattggctcggaaaaaagtacatttccggttttccggccgctccagttcttcgcgcatgctcctccctgtgatggatatgatgaggaagaggacctgcattatcaaaaaatttagaaaacataggccaacagccatatttattccagatatgttctccgacgacctctgcccccagtaattccactgcatcctttagaagcagcctttcttttccttccctgtcaaccacaatatagctcattccctcatctggagacgttttcggaccattctccgcccatgtcgttgaggaaagccaacgttcatcaattcctcccctatctgctcccagcgcataataatcgtccggatgcagcttaattcttttgccgggcctgcagaaggaacgggatacccataccggtgccaatcggaaaattccttccccttcctcaatggccctctttgccaattcttttttatccatgcttcctcctatctgcttcttgtttttacttccggaacataatatccgtaatagaaacctgcaaaccgcaacgttggacacgaacgtgattcgtcaataactacttttaccgcatccgtttttacaggctcaaatctgcatatttttttatgtcctacagccgtaccttcaaaaatctcctcccacgctccttcagtccgatatagaatacggaacttttcaatcctttgactctgcctgatatcctccataagcatacaataatcaattgttttttcactggaaaacataaattccagttcagcagtttcttttccagcagccgctttccagtagccgtccatattctggcttcttactgcctcaacaagtccatcctcagcgcagctgtctgcctgaataattgcatcctctgccagattatatgagaaggtatctctgataaaacatccgatttcattcagcctcttcacgtcattttttttgaaatatccttcccggcatggtggaacatttaatatcaggttagcattagcaccaactgtattcagataaatatccagaagttcatccaaaggccgtatacgattatcatcatgctccatataaaaccatcctggacgtatcgacgtatcgacttcacagggataccaagcaagagggccagcgccctccagagcttttctgcttcctaaatcttccattgtagaattcacctgttttgccctgaattcctcagtatcttcctgctgggaaagttccgcaacacattcagcactcatcagctttgcgggaactacactccactcctgcgccctgtgccaaccggcttcatttccgcaccagcggacatcaggccccgcaacactgataaccgcttccggctgcttttcccgtatgaaggcataatatctttcccaatcatacctctgtttttttccattctttccttctccgcaggcgccgtcgaaccagacacagaatacttttccatagcctgtaagtatctcatccagttgctgtataaaaacgtcattatagctttcagtaccataggcgggatggctcctgtcccagggtgacaaatacagtcccagcttcatatcatatttcacacatgcatcagcaacctctttcaataaatcctttccataaggcgtattcataatattataggacgttgtttttgtatcccacaggcagaaaccgtcgtgatgtttacaaaacattacgatacctttcatttctgccgctttcatactcactatccactgttccacgtccatatccgaaggattcagtatatcaagcgctgcgctgccatccccccattctatttccagataggtgttcaaaccataatgcaggaaaccgtagaactccagttcctgccatttcagctgacgttcactgggcactactgcaatcattttttctatattcttatccattactttcctttccaggcacacttatcccttaactgcgcctaccataattcctttaacaaaatatttctgcataaaagggtaaaccaaaaagattggcagggatgccagaacagtaatcgtcatacgcactcctttggaggaaatggtagataccatctggctgattcctcctgaatttacagagttcttaatctgttccgccaatcgctgtgcttcattcagatagttatataaaaggtactggagggttgtcaggctttccgttcccctcgtataaatatggttatcaaaccaggaattccactgtccgactgccacaaacacagctacagtagctataattggctttgataaaggcagtataatagcagtaaatactcttacatacccggccccatcaagcctggctgactcttccagcgactgaggcagctgttccacatatgtttttatcagaacaatattataagcagaaatcaacattggcagaatatatacccagaaattattcagcagcccataagacttgattacaatgaacgtggaaatcattccgccattaacatacatagttaaaatcagaaaacgatacacccatttgcgtgccggcatttcattcttggtaaacagatacccaagaaaggaacaggagagaactgctccggctgttcccaacaccgttcggagtactgatatcagcagcgcatgaaaaaaaccctgcagttcaaagatatcccggtagttggaaaatgaaaaacctctagggagaaaaacaggtgggtttacatccaccagtcctggttcactgaaagaataaattatgatataccaaaatggataaatgcagataaaagtaatcagcagcataagaagataattacatagcagaaagatttttcttgacatagaagtcttgcttttttttcttttcattttctcttccccctatattaccgtattaccgcgtactttttttgctatcaggtttgccagcactaccaatgttatactgaccacagattttacaatactaattgccaccccataggaataatccaaattttccaatccaattcgataaacatacaaatccagtacttctatgttgggagctgttacggaatttttaaacagcatatactgttcatagcctgtattcaggaaattaccaatattaagtataaaaaggactacataggtttccattaaagaaggcagtgttacatgtaccgcacatcgcagatatcctgcgccatccactctggccgcctcatattgctcctgatcgatacctgcaatagcagccaaatatataatggaattccagcccatagacttccactgtgccaaaaaagtctgtaatccataaacgtcttccctggaactgagcagtgactgtccctgtcctcctaacttttctaataagcctgtaagcagcccatccgacgaaaataatgagaaagccaatgaaaaaatgattacccagctgataaaattaggcagtgttgtgaatgtctgaacaaatctgcgtaccggtccattttttatctcattaagcagtattgcaaatatcataggcaatggggacaaaagtatgcttaaaactgcgaaaacagcagtattttttaaagcacgaagcacatttgaatccctgaacatcagcctaaaatattctcctcccaggaaatcacaatcctgaagcggaacaccgggaacataatcaaatacggaataaatccaaccgaatataggaatgtaattaaacagaaacaccagcagcatgaacggcattgccataatcagcagcttatattgcctgccatgcttttgtctttttaatgcggttgcagccatggggcctcctttccgggccgggccggcagtagcttctctgccggcccgtaatgtctattcgatattttcaagtccttttaaagtagtttcccaagcactctgccaccaatctacagaatcctgtgcccctgcatcctttaattgatttatcagcttttcttttgccgcagcaaatgcagcatcatcttccgcctgaattaaatccgggagtgcattcatagtcagttcctcacagttactgtcaatcctgacaatatctttaggcgttatctcaataccaatacggatatagctcttgcaattactcagatcaatcccttctcctgattctattttgtttttaagcagatcactgggaagagacaatcccaaagtttcacacatatccttttgtgcggctgtcaagctgtccgttaacacatctgcttcgttccacagactgatcttgcccccgtccgctgccacgttattcccgtcaaatcctgccatatcactgaaggttgaaccaatcccggattttttccactcatccagacggtttccgtccatcttaagctgtatggtatcctgtgttaattctggtgtgcctttttctgatttctcccatctgccctctacaccggaatcaataatacgagaacattcctcactctggatataatccaataccataactgcacgttctacattaggactgtgggatgatacgaagaaatatttaccagtccatcctgcacgattttgttcatttgtccaccctaattttgcaggaagtacaacatactgattcagggtttcaggatctccaactctttgcttctcattataaactccgaaatgccaatcgacgatacctccaagatactgtccctttgtatatttatctcttaaatcttcctgtttcgtaataaaacaatccggatcaagcagtccctctttatatagcttgttataaaatttaactccagaccagaaaggtgtcaccacctccggatttcctgcatcatataaatcaggtaccagttcatttgtcagtgcattctgtacatatatgcctccctccaaattggcatagccttcattcaggcaccctttaaaaaaataagaaaacaactgcatatcgttcataacacccaaagcatataccggcagcccttcctctgtttccgggtatatttccttcatctttttcagagcttctatatattcatcatcattgcttatttcaggacagccgatttgtttatacaaatcccatcttacaacataaccataattcaaatttgcgccgtagctgggatctgtatccttcatcagcacacgaggtgttacaaaataaagcttgccttctccattgcttttgaaagtacgtataacgtcattccgaaaagacattttatcagaattgatatttttcgctatatctccatatgtatccagatctacagcatgtttccccttcaacacacctgcaatatgatcatcatttatctgaacgatatcacatgttgttcctcccgataaatcaagattcaggctttcgttatcatacggttttgtcttgagagttacattaaacttctcttcaatctgctgtacaatttcagttggccaaccttctaccgtatctgaagaaaccatattgattccgcctatagtaatttccacatgttctgataaatcagctgtttctgtaccgttattatcgcttgttccttctggcctggtttcagacatttccgttgttgtacctgcttctgttgtatttgcagcagctgtatctgtcgtattacccgatgtacagccggccagcattcctgtcatcattaccgccactgataatacagcgattgctttttttgctttcataagcccctcctacatttctcactgcgtaaagttccggaaactttaagttgtttgtcgtttacgatataattatattttttcggaggtatttttatatgatatttctttattactatatatcttttctttttatttatatgatttttctttcaacattgacttatttcgcttttatatatacatttttaccaatcatttttctccaacatttctttttgtattttattacagaaggtaatatagcatgccgtactctcaatatctgattccatccagattcttactgtatcgccatataaaagcctaagtcttttataaacattggaaagtcctatagtgctgcttgtcttttgccctgattttaaaaatatatttaattcttccagcttatctccatcaatcggagaaccatcattacgaataacgattttaaatatatcctcttcttttattatgtgtccggttatactctttgttgtattacagcttttgccatggacaaagcagttttcaataataggctgcagtacaaatctcggaaattcctcatcatataattcctcagaacactccatctgatattccagacagttatcaaaacgcagagacatcatttcaatataatcctttaaaaagtccagttcatccttcagcttccatgtaaaatccgggtttcgaagtaccggttctataatcctgcttaatattaccaaagcatctgccgctttcgtatttttggtcatcattgccatccatcggatagagttcagagaattatacaaaaaatggggattcatctgatattgaagtgccagcagttcttcttctgatttttccttctctgccttctgtaatctgtcaatataatccttcagtctctgtaccatgtgataaaactggcggttcagttcactcagttccggccatccttcaggaatcggttccgaaatatcaagctgctcctttcccacgcaatccatttgttccattaaagtctgaatcggctttgtatatctcttgctccagactgccgcaattaatatcatgcaaagaacagctgccactgcaatcataataccaaaatttctgatgtctcttgcttcttccagatacatattttccggaagaacattaagaagcctccatccataataggataaactgtaatcaataattctcatcccttcttctgctatataaaacgtatcaatcagctcctccctggtggatgaaataacctgattcctggaatcaagcagaagagcatcactatcattataaatagcctgattataacatttacgcacttccttctcatctagtgctataagcatgaagttgtccttttctgctttttcttcctcatttaatgctttaattcctacaataaccgggcggttaaccgccgtatacaatatcccattattccctgtattcaggtcattcccggaaacccatacaacatatggatacgctttcttactttctgcaaataactcactcaattcttctgaaattacttccactcccgcccggcttttcttttccacagtcgataaaattgtccgcccgtccccattcataagcgcgacactatacaaagtgctgtcggaatttaatatttcgtcaaactcctgtatgatgctccgcaaatatatcggctgaatttttctgtcgcgtaccacatcctgcccaaattcataagctaaatcattcatggaaaaacgactcattttttccgaagcacgctccaataactccttcagtttattttcggattcctgaaaagtaatatatgtaattttttcatcattgctctttaatttgccgagaaaataattataagttatcccaaataacaaagtaattacggcaatgatacctgccaatatggataacaatacctttaaccgccagtttatttttctttttcccatctgttcttcctccaggccgcaggcgaagttcccattttctttttaaagaaacggctaaaatattccagattccgaaaaccatttctttccgctatggcaagtattttatcatttgtattttccagttcgtcaagaacatgcttcatcctgatctcatttaaaaaatccacataattttttccggtttcacttttaaacaagtgtgagaaatagctggcgctgattccgacaacatttgatatactctcaaggctcagagcatccttataatgttcctccatgtaattttttgcgttcagtataagcttttttctgtcatcacttctaacaggaaaatcctgttttcccttttgcagcagtctgcaataactgttgtaaagactctccatctctgtattttttcttctatccagaagcgatatacaaaagctgattcccagataggaatctatcgaatgccgtattttctgtaattcaatttccagactgtccgagtaacaagtcagagcacagaaatcctcctcgttgattttcacgacaactgaacgcggaatatttcgttctactacatcatagataaatttatatccaagttcattaatcatttcatgatcctctttcctgaggcgaaacataataagtttcttcacctcttcaggaacaaacgaatctccattcttacatgtcatcttttcccagcagggttcttctccgcttataaaataatcgcgcagaatatcctccgttgttttttcttttcttcctacttcttccggccacatccttttcagataactctgcactttttccaaaatccctgatatttcttccatagtcatactggctttcaaaatatatccactgatatgatatcccatcatacttctcaacgcctcaaaatcattcatacaggtaataataattatggcgcaatcctgatctatttcccttattttacgtatcagttcatatccatccataccttccatacgaatatcagttattaccaattgaggccggactttacaaaataactcatatgcctctgttccattatctgcctgtactgacagctccatatcatatttttcccatggaattgaattctgcagtcccaaccggactaacagttcatcctccgcaaataatactttatacataccctatctcacctttctgctgatataacttaaaacaaatgattgttaaaattaatctcctgctatttttactccatttttattgtatcatccccgcttatactcatcaattaaataaaagaggagaggcctcatacatcttcagcacacgctctgccagtattggtaacctttgcagtattctgcttaatgacacagtatactttcagatcctttttcacttcaccgtactgttcatacagccgtttcttttcctccgtcagccgcttgtactccgttttcatcgtggccagagcgggcagcttctctttccagcttgtaccgcgctgcccagcatcccatttagcatagctttttcccttgctctggcctggttcaccatatccacgtctcagaaaatgatgtgattatggacatgtcctttgtcaatatgggtagtcagcatctagggggatttgcctcgcaacacttcgtcgacaagcttccgccagattttattgcctgctgtaacattttacggacattcacctgttataataatttcaaaaccctaaagcgaggaataatgatatgaaacagattttgattgtcgaggacgataaccttttgaataaaacgctggcctacaatctggcgtctgacggctacgggattacctccgctgcgaacgcaaggacagccgcctctgctctgaattcaaaagtgtttgatttagtgctggtggatattaacctgcccgatggcagcggttacgacctgtgccgcctgatcaaaccgaaataccctgacacggtggtaattttcctgaccgcaaatgatcaggaatgcgaccagatacggggctatgaagccggagcggtggactacatcacaaaacccttttccatcggggccttgcagcggaaaatcagtgccatgttcgccatgttggaacaccataaactggcaaaggacatttacgacgacgggcggctgtttctggatttttcggagcaaaccgccagcttgaacggcaagcccctccccctctccactatggaatttaagatgctgaacctgttctgcaaaaatccgaagcaggtgttgacccgccagcagcttttggaaaagctgtgggacgtggatgaaaaatatgtggatgaacatacccttaccacgtctataagccgtattcgcagcaagattgaggcagacggagaaaactatatcaagaccgtttacgggatgggctatcaatggatgggaggtgaaaagaaatgaagctaaatcgcctctctgtcaaaaggctgtgcctgctgattggggccggggcgctgctctccatgttggcaattaccatcacgttttatgccctgactggtaatgaactgttttttcttatgggcgctgcgctgatgatctgcgccctgttttggctattcctgctggtgctgttctttggaaagcggctgtccctctttacttccgaattatgccagacattggacaacatgatcaacggcagcgccgaaccgcaaagggccagtgacagcgaaacactctttgcccggatcagccaccgcctgacccggctctatgagattatgcaggaaaaccgctgtaaggtggacgaggaacgcaaggagcttcaaagccttgtatcggacatttcccatcaggtaaaaacgccggtcagcaatctgaaaatggttacggacacgcttttaacaaagccggtcaccgaacaggaacgcacggaatttttgcagggaatccgcagccagacggataagctgaattttctctttcaggcgcttgtaaaaacctcccgcctggaaaccggggcaattgtgctgacaaagaaagatggtttgttatttgataccctggcacaggccatgagcgggattgtctatgctgcggagaaaaaaggcattgccgtcaccgtggactgcccgcaggatttacgcctgtaccatgacagcaaatggacaagcgaagccttgttcaatcttctggacaacgcggtaaagtacacgcctgacgggggaaaaatctgcgtgaccgtggaacagtgggaaatgtatgtaaagatagatgtaagcgacaacggcaaaggaatttccgagtccaatcaggccgccattttccggcgattttaccgggaggaagaagtacacggcgagccgggcgtgggtatcggcctgtttctggcccgtgagatcattacccggcagggaggctatatcaaggtggtgtccgaagtcggcaaaggctctgccttctctgtttttcttcccagccggtaatgcaagcggcggcctgccctccatcggctggccgccgccttttcagtcattttttgccgcctcggacatttctgtgacatttgtggtttacactggcttcatcaacaggtggaagccttgaaaggagcatttctgatatgagtattttacagacgattgaccttaaaaagtattatggcgttaaacccaacattacccgcgctctggacggtgtaaacttttccgtggagcagggcgaatttgtggccgtggtgggaacctccggcagcggcaaatccacgctgcttcacatgatgggcggacttgatacgcctacctccggtagcgtaatcgtccggggcgacgaactggcaaagaagaacgatgaagaactgacgatcttccgccgccgcaatatcggctttatctttcagaactacaatttggtgccgatcttgaatgtgtatgaaaacatcgtcctgcccgtggagctggacggcgacacagtagatcagaactttatggacggcgtggtgcgtatgctggccttgggggataagctgaaaaatatgccgaacaccctctccggcggccaacagcagcgtgtggcgattgcccgcgccctgattaccaaaccggcgattatccttgccgatgaaccgaccggaaacctggacagtaaaaccagcgccgacgttctgggacttttgaagcgcaccagcggggagtttcgccagaccatcgtcatgatcacccataacaccgaaatcgcccagcttgccgaccgtattgtgcggattgaagacggcaggatcgccgtcgaaaggagatgaccggaatgacatggccttttgaaaatgataccaacttttttgtaaagaaaatagcaaaggcagacttgaaaagccacaaaatgaaaactgtgcttttaagtatcattattatcctgtcaactttcctgatggccgttgtatttattgtctttctgaacgatgcccttgatcgggcaaatagttctgcttaccatgccatgtatcaagccgtctcccctgaaaccattgcaatcttggaaacagaacctcaatttgacaaagtgggtttttataagtattttggcagcagcacgacagaaagcggacgggccaattatgcttatatggataaaatggttatggatgcgactggatgccatattcttggcgggacgtttccccaaaaggaaaacgaagttttagtatctaaacaatacttgaaaatcagcggacaatcccatcaaattggcgatatgataacgctctcctatattgatagtttgacccaccgcccagtgacacgggatttcaatatctgtggcttgatagaaaatgcggagcaggaaaaagcaaagcaatacgattttttgttttcagatgcttaccggctttccgtgattcaggaaaatgccgatgtggaaacttcccattttacagaccaacgaccggatacgcttgacgtggttgtatgtttgaatacggcatcctccagcatgacggcagaggaaacactggaattactcaaggcaattggaacctctgccggagtaagcgattacaatgttatcctgaattatgattatatcgagggtgtaaaatttgagccgacgcagatttttctgtttgcctcctttgccctgctgcttatgtttgcaagcagttttgctatatacagcattttctatatttccgttacagactctatccatacattcgcacagctaaaatcgttagggacaactggaacgcaattaaaagctttcttgcgcgttcagggaaacattttggcaatacggtgtattcctgtcgggatgctgcttgcattattcatcggaatgttgctctcgtcaggtacatggattctggaagacatggtaattgcgcttgcttcgggccttttaataaaatgtgttatcagtctttctctacaaaaaccctcaaaaatcttagctaagatttctccgattgaagctatgaaatatgttgaagccagagaccagaaataccataaaaccttacacaaaattacgccaaaaagccttgctgaaaatagtctgagggtaaataaaaagaaaaacaggatgtccataatctcactttccataagcgggacactaattattgctatggcgctgttcattggttccataaacttaaaaactatgatgctgcaaacctatccgctgaatgaaaacttcatgattggcgtatcattagataatttttatgaacgcctgccgcaaatagcaaaggataatccttttacggacgatcttttacgggaagtgactcatattgccggcgttgaaaaagtaataaaggatgaaagtatcatcgtccgggtaaaagctcccatactcacagacagcgatggagaacctatgcgggaagtaataaattctatatcgcctgaactcattgaaaatgtgggagaaattgtagatggtaatgtggattatacaactttgggaacagatggcgtcatattaaaccagtttcggattgatagaagcaatgtcccaatggactttagtgtgggtgataaaattacctttgagatcaataccggggatggcgtaaccgaaaaagaattttccgtaaaaggaattgcctattttcaggatgttgggctgttttatgtatctcctgatactattcatgaagtatcttcttataattggacaacacatatttccgttttctgtgcgcacgataatgagcgggcagtgcaaaacagcctgcaggaattggtcaacaggaatacaaatctcactctgaaagtgtatctggacgatttttcaatgatcgaaaactggatgaatgcaattatgggcagtgtttacggtgtttgtttattcctattcctatttggtatccttaatatggtaaatatactgattaccagcatgatcgtgagaaagcaggagtttgcactgctgcaggctgtaggaatgagcggaaaacagctgcggtcgatgctttatcaagagggacttggcataagtctgaaatcccttttagtgtctgtcattttaggtgtcgtctgtggttatgggctttcttatctgggtcgcgacattctttcttttaagtttatttcgttccatttttctgtgttccctgttttgctgtttggtttattgatgattgggcttcaaatggcaatcagctattccatttgcaaaacgattgagaaaaaaacattgacagagcggctgcgatcagaataacgcaattgacagtgattttctgctgaaatgcgtttagcttagcggggcggccctggccgccccactggttttctctgaaagatattgatgatggtattgataccatcatcaagaaaattactgtcagcctcgtctaagaatcagcatggtaatatcatcaaactgcggcgcacccttggcaaacagatccagctctgctttgatgccgtgcaggatgctttccagttcttctccctgatggctgttcagataggtctgcagcttttcctctccatacatcttctcatagatatcggtggcctccgtcacaccgtccgtatacagatacagggtatcccggctttccagcttcagatgcgcctccctgtatataatcccttccattcccgccaggacaaggccgctgcgcatcttgagatatgcaaagcttccttccgcccttcccagcagcggaggattgtgccccgcattggtatagacaagctcccctgtggaaatcgtcaggatccccatccatgccgttacgaacaatccggcttcattgttctcacacagtgtctggtttaccgcagtaaacgcctgcccggggctttcccccatctggacatgatttttaatcagtgtttttgtaatgaccataaaaagcgccgccggaacacctttcccggacacgtccgcaatgacaattgccagatgatccggatccaccaggaaaaagtcatagaaatctccgcccacctccttggccggcgtcatggtggcataaatatcgaattccgaacgctcgggaaacgccgggaaaatacagggcagcattgacgcctgtatctgtgtcgccactgaaagctccgccccgatccgttccttttccgccgtaatcgctgttatatcttcaatatatccgttgatatcctgttccatctgctgtaacgccatgcacaggttttccacctcatctcccgtgtggatctccagcttttccagggcggaccggccatctttcccgccggccttctttttttcctccacataggacactgctgccgccgccaggctgttaatgggttttatcaccacgcggtttaccagaccaataaataaaagcaccaggagcgttgtaataaccagcattaccagacagatatggactaaaaaatcctgtctgtcattcatcaccgcctccatggaaatgtccgccatcgcatggcccactacccttccgtccgcatcttttatggccaccccggcagaacagagccagccatactcctgcgtatccgtgatataagccgggaagctggtttccggatgtttaaacacctggtaattctgttcataaatgatatcccactgtccggtgggacagccgttttccgagctgtcggcgtccaccagatatacccctgtcttactttcgtcatccacataggtaatataaagtgacagcacgtcgttggcttcttttattatccccagaagctcctgcacggccaggtaatcctgatccttcaacgagtcatactgactgaaatatgccgcccgatcctcttcctttccaaatacaggcgcgggattttgggaataaatagcatccacctcatccctgtatgttcccacccagcccggatctaccagcccggcggcagtgcgggccacatcaacagccagcatctgataatgcttatccatagtttcggcatagatccgatagctgtttaaaacagccgctgcggtaaggacaagggcaagtaccaatatcaccaataccgatttttttccaagagatactttttttctcacatcaacctcctaaatcctgaccaccagagtattaaagccctgataccggcggtagaaaaattcctctgccttctcccggattaccaggattcccagggcatccggattcaccttttcatcccctcccagcctgctcgtatacagagaaaagggattaaaggacaccgcattgtcgcggatatgcaaagagaaagcgccacctgcctccgcaaccagcgttatctggatataaccgtccgtttctccaaagccgttctgcataatggcggcgcaaagctcctccaccgtcatggttacaaagtaaatctgttttgccgcagcctcccaccttttacagaagctttctatttccgaaagcagggaagaaagctcctcatatttattatgaatggttgcggtataaacccgtccctcctcagattcctcctgcctccccgcagtgtatctgcagtatcctgcgaaaataagaagggtaagcacctccgtcaccggatacagccaccagaagaacctccctccccatgcagaaaaaagcagcgtaaccggaagcagcactgccgctccccgcaggatcgtaatcaggtaggctttcttctcttccccgcatgcctggtaacagccttccagcaaaatacatactcccgccaaaagggcactcacacaatagacacgcagcgcatatgctcctgtccttaaagctttcgaatccgtaatcccgaaaacaaggcagatgctctggggaaaacaggctgtcaccaatgccaccatgcctcccgccgtcagcccccgggagagcgccagccgcatggtacaccttctgccggggcggttatgctccccgcaataggtgcttaacagcggctgcgccgctttcacagcgccgtcatacagatagataatcaggaaggatacgttttgaaccacgtcaaacactgcaaccccaacgcttcccatgctccgcagcaaaacacgattagcgcacaacaaaaagaccatggaaaaaagatactgcgaggaggaagcaaagcccgccttaaaacaactgaggcttcctttcgagtccggacaaaacggtaggagccggaggctgtgggttttcccggaaaatcccggcaggtaaacacaaatggaaatcagctgtcctgccagcgtcgcccaggctgctcccgcagctcccccatccagaagcaggacaaaaaccacattcaggacaatatcgcttaagtttcccaccgtaaaaccaaatccggccagcttttcactgtcgtcgttgcgcagaaaatagttcatgacataagcggtaaaaaataacggcattcccgacagaatgatctgtaaataggtacggctcaccgcaaaaagcgctccgtctgcttcggttgtccccagcagtgcaagaagcggcgtcataaacagattggctccgatactcagcagggcgcttataataagcgccgctgacagtatcccctgaaaccctctaattccctcctccttttttccctttgccatcaggccggaaaatcgaatggccccgcccagtcccaggccatgcatcagcacattcatcaccataaaggaaggaagcgccaggctgatggccgcaagccccgttacgcccatacgctgcccaactacaatgccatccatcatatccccaaaagcaaggccgcatgcggagatgatggccggaacgaactgtttccgaaatatttttttcgtaaagtaatcctcatgcttccgttccaattgcagccgccctcccttcatacatccgaagcagccccacaggccgcatccgctgtttcatccgacgcagcccctcgatccccagatcctcttctccatttaccagtgaatatttctccggcagaaaggagcaaagcgcatgccgtgtatattcggacatacccgttatgtagcagctttgtttgcccaggctgatatcaaacatattttttccaatgggatatcccgccatcaccgctcccggagctccgtcaacccgcaccagaattcctgccccctccagctcttcccaataggtaagcattgtcacggaggcgtccgtatcccgcaggccgtccaacccttcctcccgttccttctccttccatcccgaaaccagggaaagcgcatccgccaggttttctgcgcccacaggctcccattccagcaggtggccggcagtaagcctgtggatatacttacgggccgcaaggaaccccttcccattcatttcctgctgctcttttctgtcataaatatattcatggtcggattcccgttccctgatttggaaccttcccgggaattcctgttccagaaattccgcgtcctcccggcgcatataacaaaaaagcagtccctcaccatcgaggcacctgcagataaaatcccttaccgcggttctgccgccacaggggaaaaaccatgcgttctctccctgcatccgacacttcacggcaaataaattctcttccagatatacggacagccccatctccttctgccacataaaaagggacgcaaaagcatgggaagctgtaatatggccgttttcgtaccggattccttctatggtatccttcatggaaagtgtgagaggcatggttcgtatattcatagcttccttaccctcctggcaacgattgttcccccacgtaccggcagccctttttcccctccatacacagccggatatgcccttccttccatcacaccatagatctcatcccggtttcgatagatacattcataaccatagaaagcccgcaggatacgatctgcttcggaaacatccatatcaggcgtaaccggataattgctttcctccggacagggccagtattccccctctccctggggacgcgccatttcatacagatgacaaaaatcagacgccagctccgccatcataccgggaagcagcgtctgtagtctggccgtcagggtctgcagggtgtcctccggcatcaccggcactgccttctgcgacagaatatccccctcgtcaaagtcatccgtcattttatgtatggttatcccgctttcccttaatccctccaggagagtgaccggcatgggccaggctccccttcctttgggcagaagagcgggatgaatatttaccatgggcagcttttcatccacgggaatacgataataatatccgcagcagataagcgcatcgattcccgcttccttccatcgttttacatcctcccgcgtaatctttccaatgagaaggggtatcgaatgctcctttgcaaaggcgcaggtgcgcagattaaattccgtctcattatccacagggcagctgacgatttcgcacacccggcagccggcctttacaagcgccggcagtgcctgatacagcgtatcaattcctacatatacaatcttccagttcatgattaccagatgctgaccctttcttccggcgacttatacattccgtctcccggaacaacaccatatgcttcatagaattcaggcatggaagaaagaaccgcattcactcttatctttccgggagaatgagtatcggaaagcattaacattttcgtagcatccggcgtatactttactgcccagatccatgcatactgattatacagggctttcctgtccaccccttctgtacaggcgatttccgttatggcggacacgcctcccaaatccgcaatattctctgtcaaagtctgctttccgttcacctgtagtcccgcattttcataaccattgtaatattcaactaccctttgtgacagctcttcaaacttcaccagatcttcctgggtccaccagtttctgtaattccctttagaatcatacttggctccggtgttatcaaaggcatgggtaatctcatgccctatcaccgtaccaattccaccccaattttcttcggcagacgcattcttatcataaaacggagactgcagtattcctgccggaaaataaatggcattttcactgggcatgtaaaatgcatttaccgtaaaggcatcggcttgttcccatttcttccgatctgtgggttcctctcttttttcataggaatcctgaatggaaattctgtacagattcaatacattatcaatcaggtttcccccttctgcgggagaatagatacggacagcatccatataggagggccattgatccggatatcccaccttaactgtcatgctgttaattttcttaaccgcctccacttttgtggcatcctgcatccagtcaagcttgataattctttccctgtatacgtccagcacctgttttaccatgttttccacttcaattttggattccttatcaaaacagttttccacatagacctggctgcagaagtcattcagcaccgtttttaccagcgaaagggaaatcttttccggtgattttgcagtaacggttccctcctgcgcctgctggaaatctcccagcgcattctgggattccatatccgaccagtcggaacagatataatagaatatcgtcttcacatattccttcaagagggaaagatttccatctgtcatcaggctgccgaagctggcaagatattcaggttcaccgacaataattttgttattttcctgcgcctcataaaggctgcagaataaatccatcggcaggccgctgcagaagatttccttcaggtctgaaacctgataggcatgataaagcttttcaggatcataatattcctgtatttcataggtagcggcggaaagcgtcctgcatagagtacagatctgatccgccagggcatccgcgtcctcttttgtttttccgtttatctgatgcagtgtggatataaagctcctggccgcctccctgacagaaaggctgtaatcatcctcaccaaaccaatattccttacttaaaaaagcagtgcccgccgatacataaagtaccttttcatccacgttcttcgtatccacgccatagcctgccgaaaacagtgtgccgattccataggttctgtccagcttcatgacaactgaaagcagctcctccatgttctgcgcacggtcaacgtcggctaaaaatttgtttccgaccgtaccataacaataagcgtttctcgtatccgcatccatagcgcacagatagagcgcgcccagctgatattccttgctgtttttatcataggaatctatgttatctgcgtaatttataatatagcctttaagctcctcatccaccttatttctcaactgataaaaccagccggttcccgatgcatcatcgttaattttcatcccggcaattaattttgcatccaccgcttcatagaaatcctccctggcctgaccgggatcgacgctttggggagcagcatccgcagtcagcggagtcagaagcattccaaaacttaggactatggccatcagccatgagaataccctgtttttattcataatttgaacctcttttctctttctgtgtttctattcgttttatgtgactgcttcattacttcacgatcactgtttgttttatatcaatctcccgcttttcttttccgggtcgacaatagcccgtacccgtagaggattgatagggtgatctgtcattaaatttactatccaccgcgccatacgctccagtacgttgggtttcttataaatattctgtaaataatcatccacatccacataaggatataaatgacgtcccaccgtcagcatcgccatacatctgattcccatatcctcggtaagcacctgggccaccctgtccgcggaatattcctgggaccggctgtacatcggccccaccagcggtattattctggcgaacaatatgctgaaattatgtaacagggttggatggttaaaatattgatgtccaaactcatgagccatagtaaaatagactacgtcaaaatctttattttccatatacgcaatgtcgacaatttccgcattcaactgtatatatcttcttcccagaacccatgatgcaaaagcattgagtatcccgttttgctgagttatgtagacctccgggacttttttcagacccagcagtctggcaaactccacgcttttttcataaatttcaggaaaattcttagacgttactttaaccgaataagatagctcttttgcataagcctgatataatacgcataaaaaaagcacaattatataagctatcatcaaaaaggcgaatcctttatccaatccctctaacaagtcggaaatgtcagcattctccactacttctgaaaaatcatcaatattgtccactacgatagttactattataatgcccagccaaattatactattgatagcaaacatcacccagtaaatgggtctttctcccttatgtctgaccttgcggatttccctgcggacttcatttgttgtacgctccatattttcctccttctgctgtaccttgacagttctgttactacgcttcgattttcatgatatcagtaaatcccgtggcttcaaaaacctctgcaattatctggttgggatggcgtaccaccatgctccccttccgtgaattcatcagcttctgagtcataagaatcacccgcagcccagcgctggaaatgtaatccagatccttaaaatcaaaaataacctcgctgagctcctctgtagcggtagccttcaccgcttccgtcagctccggggccgtattagtatccagcctccctgtcagcttaaattccatacttccaccgtttttcaccttagtaatctccattttgcttcccttccgcgctcttaaacgcctgttactataattatgctaacaatcttaaacctcctgttttttcttatcatggactgccgcttctttgctcctgtcagattgtttttttcagcgtcagaatgttctggccgcctttataagcataggaaatctgatccatggacttttttacgagtaaaatgcccagccctccgatttttctttccccggccggcagggtggtgtccgcctcagatacagcaaggggatcaaagggacgcccgttatccaaaaactccagtatcacctgaagaggattcccctccacgctgcagatgatggtcgctttcccaatccccggtttatatgcgtagtgcgcaatatttacatatatttcttccgctgccatggaaatctgcatcatagcctttaccggacagccgcttgcttccagctcctgttctataaaactctgtaccttttccagattttccagcgtagcatccacagtaattgatttcatctcttcatttcccctgcttcttaatagtctctatagctttacaattaaattattcagaccaatcgtatttctgtaatccgtacctacagagattctcttcaccaaacgaatacctatattcttgcatggatccgcatcctcctgaagcttttccagcggattgaagggtatgccgtcatcccgtatcctgaaaatcagctgttctttcttaatcagtactctgatatcaataaaatgtttttttccatcagtaaatgcatgctgcaccacattcccggtcatttcttctatgcacagagaaagatgatgcgttcttcttttatcaatcccttgcttcctgcagaatctaccaatattttcagaaagaataatcaccttatccatatcattttccagtgaaagtgaaagctgctgttcctccggtacgccaaaatcctccggcagaagaaggaaatcctccagggaacgggggaaatgtctcttcttccatgcaaccacaccggttaatgccattagcatggctccttctcccagcaaaaatgaaatccaaacgccatccgttccaaacacaggtgataaaatacctataaacaacatcataaagaaaaagttatcccccacgcacatgaagttggccataggcagattcccggcactctggtaataattcaggaaaaccagattaacggtatacaaagggaggctcaaaaggaaccagaacataaccctcacagccatagaggccgcttcaggattatccctgccaaacatcatcaccagaggctttaaaaacaacaagctggcggcacagacaatcaccgtaagcagcactcccgtttttattgatactctgacggaatcctccagggtcctcttgtcttcttctccgtaaaaaattccgctgatcagcagcgtagtcgctcctatccctgtacagatggaaccaagaatggagttcaggctgttctgtatggagaatgcagtcagcgcaacatctccggtcaaaagcatgagcacatgattggtcagcgccgtccttgctgtaatgcagattttattcaacgcattgggaaagcctgtttttccaatagtacatagttctctgaacggatttttcaccctgacaaaacgaagagaattgacgggcttgaaaaaatggatgagacatatgaaaaccgctgcaaaatagctgatggaagtggccattgccattccgaacatgcccagatggaagaaaagtacgttacaaaaatccagagtgatgttaataaccgtcatcacaataatactgtaaagccccagcctgggagaaccatccgttttggtaaaagccatcagcacctgagaaataatgataggtaaggctcccgctcccagcccccggatataagcggcggccagaggcaggatttctccttccgctcccaggaatccggcggcggtttccgggaaaataaggcaggcagctgcgcaaatcagggccgcagccccggcacagataaccgcaatggtaaatacttcatttacctttcccggctgatcccttccgatatatttaccgcacagactgatgcttccattgctgaaaacaccagccactgccgaaaaaagaataaacaagggactgacgattccgaaagccgccatggatgccgaacccaggaaattgccaatcacaatcccgtctaccatcatacctatcgtagccgccgccatcgcggcaatggaaatggagaggtattttctgaaaacctttttcgttatgtaatcactggtcatgtcctattttctgttccttcctggtccagcatatccaaaagtcctgtcatggctatcacttccccgacatcctcatttactcctgaaagagaaagctttgcaaagtttttatatgccttcagcaatactctgattcccgcactgcttatataaacaagctccgtgcagtccagcttcaacctttgcgtcccattttccttcagctgcataatctttttttccgtttccggagctgtcagagcatccagacgcccctccagataaacgatggcttccgccccttctctgctttctttccagtgctgttgcgaatccgtttctcccgaggcaaaccccgccttgaatgctcctgcctgcctcattatcatatcgaagccatccagcacattttcctgcatcagcgggaagattacaaattgcctggccttctccagatctgatacgatcccgctgctgcgtatcctggataacgacactgccataatgcttgtccggtactctatgaacagctcaagaagctgccaatgctcttcgggaagcttcagatgcagctcatagccggttctgaaataaggaaggatatcctcattcagcgcatctctcctgcatttttccatatggtatccattcataagccaggtgatgcaggcagaggcaatatcatacataaaataaccataattacattcgtcaaaatcaaaaatccagatattatttccgtccacaaaataattattggaatggaaatctccgtgtatcatcccaaaccagcgcgggtcctcaggaaccgccttcactttttcataaattccgtcgatccgctccatcagatcagccggaagattttcccttgcatatgcaaaagacggcgcctgcttttcataccatttttttcttttataactaatccctgcttttgcgctgtcggcgccggcagcatggatacgtcccagcagatctcccacggcaatgaaatgcatggcatccagatctgtaatctcccgtaccgctccccttgctgtccggaacatggccgcccgataatgaacaccatcgatctcaaattcctctacaatatgatttttcagggaaggaaagggttcacatacagtttcgctgaactgtttgagatcatccacccacagcacctcactcatcgtttcttcccttgttttcacggagccgatgctgacacggatcatatgcggctctcccggaaaaataaatgcataattctgtgttgaaaagaaacattttgccttattgatatccaaaccgtaacatttcagcagttcttctctgagtacctgtaattctttttccaatttattttactccttatattccaaaagctgattttattggatttgcaagctccccggcaatgtctgcaacgtctgcttcaaatataaaataatcgcattctgcatggacatcgttcataacgtaaattgcaacgcccgtatctgttaaaaaataattataaatttcatctgttccaagcacataatctttaaatgcctgttctgccttggctgccagttcatcaggcacatcgtcactcggcagagtcagcttaaacatttggatctgctcctgtgtaaaagggaccgcattcagagcgccaaccggctctccggtcgtaacatcaaatgtctgcgcacttacctcattgacagaatatgccgcaccctcggctgtcacatttaaatatcgctgtacactgagaagtttttcccctacaaaggcatatgtcgccgtaccgtaatattcggtcctatcagcttcgctgtccacaccgttggtccactgccacaagtaaaactccataatgttctcattgagttttccctgaataatatcatatagatctgcaacctggatatactctacctctacatgatcagcagtataagtttccagattaaatttaacattatcataatcatcttctatagcagaccccaatgtctcagattcattttgcccctccgccgggatgcttgtttccaccggcgctgcaggctcggagatatccgcctctgtttcagaatgcgtataggcagcggaagtttccctttttgtattttccccggagcaagccggcaataccgcgcaaacacagaaagccataaggattgtcatcagtgttttccggtttcgcacattcttcatttaaacattccctccataagtggtatttttaccaaatgatcaatctgtcctcgggggccaaatacatgccgtctgattccgttacgccaaaagccttataaaattcatcaaactgctgcaccggcacattggttctttgataatcgagcggatgcggatccccttgaatttggctcaattcaacactatagagggaaacagaagtattcattttagcgtaatattcaaaaaatttggcataatcaaagttttcttctttctcagccatcttaagcgcacattgtaagcctgtcatgtccgcaatcatttcactgtctatgttgcttccattcgcataataatcatccataatcaatataccgtccaggtactggtccatcttctttactctttcgttgaatccggcaaaatcttcctccggccaccagttattcagatttccttccaaatcatactgggaaccattgctgtcaaacgcatgggagatttcgtgaccaatccaaaatgcaccgagagacgcatacagttcctcaacaggcatatcggaataataaaaaggacttcccatcatccctacaatcatatttatggaattatccgaattactgtaaaaagcattgcactccagcacacataagtcgtcggcccacatttctttatcaggggcagttcccagtagatttatcgccagatccatattatattttccgatttttttcagagcctcataataagagagtccgtcaatatcaagcctggaataatcctgccatttatccggccagcccacatggactgccatggaatccagttttttaagcgcataagctattgtttccggtgttgcccagtcatttcccgacaaaatctcatgataagtatcgattaccctataacacatatcctcaacccgctgacgatcctcctcagagctgtacatcttaatatattccttagacagggaatccggcagaatactttttacaagggaaaaggctttttcctccagaggcctgtctcctgatgagccgtaatattgattgctcagtttcgtcacggtctgcatcgtatcttcatcaagtgcgctgctttgattcaaaacaaattttaccagaatataatttttgagcattgttgcattctcttttgtaaatatcccgtcaaggcagcggatataatccggatctgtgacaatatatccgccatcatagccgagttcattcgcttctaatacttctttcagcggatatgtatttaccagttccgttagttcttccaatgtcattacattattgactctctccataaaatccgaacgcatgctttcctcgtccgtatagatatgaggggccagtttccgctccaattcgatggcatcctgaaaacatgtaagcgcattctctctgtccatgccaaggcgatccatcatgtatatgaaaatctcctcattgaaatcatgaagcagtgtgccgtattcattctcctccagataattcgctgaatcactcatgataaggcccggggaagaaatccatacataatatgagtctgcatcagaaataccggtgctgatgctgacacccatcagattttccacttcatatttgagatcgggctccaaatacagtgccttaatatcgtccaggctttctgctgcaagaattttttctacgcttcccttaatcggatcatatccggccttatttctcgcatccacatccatatacagatcaaacattccctgtaccagcttggcatcatgaccaggcaaatcatttccgtcgagcatctttatcgctttttccatggtgtcctttgcaaccgcagaataatttgaccaactataataaccatcgggaagttccgtatccaatatccagtctttattgacaaacaaatgaaaatcctgcttcgggtctgttggagtatctttggttacatttccaatcaggcaggaattcagccatggagttccattcgcatggttgccctcctctgcagtctcatccatcacttgggcttcttctgatgcagcctctgagttttgcgctgccgcagacacttccgtatctgttgctgcttcgcggcccgcaacagcggcagtatccgtatgtgccgctccgcaacctgcaagactactgattagtatggacagtaccaatatacctgttgctactttccttttcatatttgctctccaatcttttttgttctttgtccgtattctccatcatgaaacccaaaaagctctttcagatttacacctcctattatgtgaatcgttcttttattaagcaacacaccttccgaaaactatactttttattccgaaatcaattcacaaaaaagcaaaactgaagccttgtagacgttaccttcttgtgaaaagcgcactgtaccatgatatttttccgccacagccttaaccgaattctgcccgataccgcaagcctgcctgatcccttttctgtcatatgatttttcttctacggagttatcgacggttaatatcagcttgttattctcaataccgcatctggcaaaaataaagcgcctgccgctggactgtcctatgacactgtgttccgcgttctcaaataaattaccgaatacaatcgtcaaatccgtatctttaatgcctgtatctgcaggaagctccagctttacatccacctcagcccctgcttcctttgcctgctgaagataatacctcaccaacacatccactgtgtgattgccgcatacctgaagttcattttcaaagggaagattttgtctgtattctgccagataggctgcaagaccattcatatcattctgctctataaaagatgtcatcgctgtcagatgatgacgcaggtcatgccttaatgcccgtgatgtttcgatactctctgtaagctgcaggtagctttggacctgcacttccatttgctgttccatcgctgctacgctggtttccagacgaatacgacgagccgcattcaaaaccaaacgcacattgataaaataagtcacaagtcccgtagcgctaattaataaaaatataccgatggcctgttcctggggaattgccgtattatttcccatatcgttaaaaattactgtcacaataaatatcaatatcggtgaaatacacaaaagccagaaatcacggttgcgcagctcctccatggcttccctgagctgatgcacaaaaaaataccatatggtgggcataagcactgctgttatcaaaagaattacaaggctgtaagcaagattactttgtaaactaatccgttctccgggataaaaaggcctcagcaaaatagctgctgtataatttatagctgtggataccgcctgtaccagaagaaatatgtataatattttaaccggagctaccctgaacccccataaaaacaagccgaacataactgcatataatatgagaaacacaatactgctgtgacaaatataattttcattttgcagctgaaaaaagaaattgcataaaaagaagaaaatactgactgttgagatcacaaagaccatcacagcacggctgactcttctttgaggataaaaaggaacacagcatattacaaaccagggtaccgtacaaataaatcggccaatactcagtaacaccgccccttgcatatcaatccctcctccgcattttctcaaacaaatagctttcataattctcacgcatccgggcccgttctgcctgacgcataggaatctctgcatcatctattgtatagaaaaagtttttatcaactctatttaccaaatccatattaatcaggaagctgcggtgacagcgtagaaatcgtgggtcactcagaagctgctgcaattcatccaaatgaatataacttctcacatcttctgtcttcagatgcagccaacatactttatcatttgactctgcccaaatcaattctgagagaagaatcttcctcttttctctgtttaccataatttcaatataacattctgcctttcccacctgcttaatgcaacgttccagcgctgtcctgacgtccgtttttttgtatggttttacgagataatgtacagcccccacttcaaagccctccgcgaaataatccctgctggaagtgacaaatacgattgccgcttctgttcccctggcacgcagggctctggctgtatccacgccgttggttttaaccatgaatatatccagaaaataaatctgaaaagataacttctgagccgccgcaagtaatgcttctccgctttcataggataaaatctccgcacaaattctgagtctctccaattctgtattcagatattcaagtaataactgcctgtcatttttctggtcttcacaaactgcaatgagcacaatgcatcctccatttcttttcctcttctttcaatgacatattttcaagattcatggtttcaaattattggtaatggtgtttctctctctcagttcatcccaccttcaaattagtaccacatatgtacaaaagctttctgcccttaattgtattaaatatgtatttaattttaattaatggacactttttcttagttattatgcacttaatacaatttttaatcaactaaattggcgaaaacaatatacttaatgtcgaaatctattaacttatcttttaagaaaaaaattaaattcagcactttcatattgttctctattgttcttaaaaaacggcctaaaatcagtccgcttccatgaactcagatacaacctgaacaagtgctttaagcccccggcataagcataaaagatatcaagaaatggctggggcacagctactctcttccctgaatatttatactcacttagattatagaaataaggtttccagcacaaatgcaattatagggattcttcctgtaagaaatgaaaaaggaccctttccagcggcagactgaagaaagagtcccttcataaaatagtacgggtagccggacttgaaccggcatagtatcgctaccgagggattttaactccgctggaaaaacacgaacaatatatgttggcagcataaaactgccaccagttttcgtctggtggcagaaataattttttgtctttgtctacttgacgggaaacagttcattttgcagcatacgggcaaatttcatataatcatccagcgtagagacaagccctgctccgccggatgcaaaagcaggttcacgggacatatcgttgcggatacccagatggctgcctgtataccttaccagcttcctttgcccgtcctgtgtccttatactttcatacacgttcgtaagtctgtgttgtttttcctgaggtatccaaaacgccgtatcctccatccccagcggttccagaatctcttttgcatacataaattatacatacagtattgcttaaaaaaaaatatccgtttcttgcattatctgctcatttctgactatatactgctgtccggggtatcacaggagatgccgcatatttggcggtaagcttttcctgcctgtcataaatgcctggtgccttagaccctttactttatcccaatggttggcccttttgtcttttttgttctaaaggaggccgattctggaaaacacttcctggtaggcctcctctgctccgcccatatcccgcctgaaacggtccttatccagcttttctttggttttactgtcccacagcctgcaggtgtctggggaaatttcatccgcaagaagaatcttgccatcaaatcttccaaattccagtttgaaatcaattagctcaatgcctgcggccgcaaagaaatttcgcagtacctcattgaccgcaaaagcagtctccgtgattttttcgatttcctcttcggtagccagattcaacgccagcgcataccagtgattgataaatggatcccccagtgcatcatttttataggaaaattccactgttgggcattttaatgttctgccctcttcaatgcccatgcgttttgcgaagctgccggcgcccacattgcggacaataacctccaaaggtacgatttccacttttttcacaagagtttccctgtcattcagctcctttacaaaatgagtgtgaatcccgtttttctccagcagttcaaacaggagattgctcattcggttgttaatggaaccttttccgtcaatcgtccctttcttctgcccgttaaaggcggtagcatcatccttgtagctgacaatcaccatgtttgggtcatcagttgcgaaaaccttttttgcttttccttcatataactgttctcttttttccatgactgtctcctgttctgatttgtacattttatattgttccttaaaggcctgtatagcccatcagagattcgtcgatccgggcagcggcttctgtgccttctgcgatagcccagaccaccagggactgtcctctgtgcatatcgcctgccgtaaaaattctggtgttttcggtacaataagaaccgggagctgtctccacattcgtcctcccgtctaatttgacaccaaaagtttctgcactgtaactctcgctgcccaaaaaacctgctgcaatgagcacaagatctgcaggaatttctttttcggttccggggacgggctccatgcgcatccggcccgtcttttcgtcacgtacgggcgccagctgtactgttttggcaccgcataaatctccctttttattttttaggaattcggtaaccgtcgtctgataaattcttgggtcatggccaaatcggtcaatcgcttcttcctgcccgtaatcagtctttaacacctttggccattcaggccagggattgttggccatccgccctgcgggtgctttcggcatcatttccagctgagccacactggcggcgcccagtcggataacggttcccacacagtcgtttcctgtgtcgccgccgccgatcaccagcacctttttccctctggcaaggtaatagggtatttctttaaaattgctgtccagcagcgttttggtcacatttttgagaaagtccaccgcaaaataaattccttttgcatctctgccaggcacttcaatatctctcgggtttgatgcacctccggccagaaggatgcggtcatattttttgagcaactcctttccggggaggttccttcccacatccactccgcattcaaaacggacgcctgcttcctccatgagacgaatgcgtctgtctatgatacctttttccagcttcatattaggaatgccatagcgaagcagcccacctggacggtcgcttctttcatataccgtcacgctgtggccgcggcggtttaacagtaaagctgccgccagtcctgccggcccgctgccgataaccgctacggtctttcctgtgcgcacacggggagagtcagcctttaccagtcctttcgagaaggcatactcgattacagctttttcattttcctttgtagataccggttcaccgtgcagaccgcaggtacaagccgcttcacacaaagccgggcagaccctggaggtgaattccgggaagcaatgggtttttgacagtctgatataggcctgctcccagttgccgcgatataccaggtcgttgatttccggtaccaggttatgcagcggacagcctgatgccatgccggcgatcatcactcccgcctgacagaagggcacgccacattccatgcatcttgctccctgaaggcgctgttgttcttcggaaagggtgccatggaagtctctgaaatttttaattctttcgcccggagctgacaccggtcccgttttccgttcatattccaaaaaacccgtcgattttcccattctttttcctcactttctactgacgcccgcatagaatgcttctatctgtgcctcctgtctgctcatgccctgttcttcaaactgggaagacaactgaatcagatgtttgtaatctgcaggaatgatttttttaaaggcaggcagatattgtgcaaaatgtgccagaatttcttgcccttttcgggaattggtgtgggccacatgggcttcgatcatggcccgcagctcttcctggtcatatttggtttccaccttttccatgagcaccatttctttattcagatttttatacagacaatttccctcatccagcacataggcgatgccgccgctcatgccggccgcaaagtttttaccggtgggtccaagcaccgccgtccggcctccggtcatatattcacatccgtgctcacccacgccttccacaaccgctgttgcgccggaatttctcacacagaagcgttcgcctgccatgccggcgatataggcttcccctccggtggccccgtagagagcgacattgcctataatgacattttcttccggcacaaagtttgcttccggtggcgcataaaccgccagttttccgccggagaggcctttgccgaaataatcgttgctgtcgccgcacaaagacaaggtgatccctttgggcagaaatgcgccgaagctttgtccgcccgctccctgacagagtatggtaatggtatcctccggcaatccggaaggatgatgccgtgtcacctcagcccccagcagggttccgaaggtgcggtcggtgttggtcagcttaacctgatagctgctctttttcccctgaaccaccgactccagaatttctttgtttttcagaagctctgcttcatcctttgtctgctcaagctgaaaatgataggcacagtccggatcaaatacacagttcttcctttctccttcgttcattccctgcagaataaggcttaaatccaccttcgctgcctgtcctgtcaggaaatcctttttctttaacagatctgtacggcctaccatttcatccacggtgcgcacgcccagcttcgccatatattcccgcagttgctgtgcaataaagagcataaaattcatcacatactccggttttccagtaaaccgtttgcgaagttccggattttgggtggcaatgcccatagggcatgtatccagattgcagacccgcatcatcacacagccgagcgtcaccaggggagccgtagcaaaaccgaattcctctgcgccaagaagggctgctatggccacgtcacggccgctcatgagcttaccgtctgtttcaatgaccacccgattacggagcccgttgcgcaagagtgtctgatgtgtttccgcaagccccagctcccagggcagtcccgcattgtggatggaacttaccggcgcggccccggtgccgccgtcatagccggaaatcaggataacctgggcccccgctttcgcgacccctgctgccaccgtgccaacgcctgcctcagacaccagctttacagatatacgggcatatttattggcgtttttcagatcataaatcagctgcgccagatcctcaatggaatagatatcgtgatgcggcggcggagaaatcaggcttacgccaggcgtggaatgacgggttctggcaatccacgggtatacctttttggcgggaagatggccgccctcaccaggttttgccccctgcgccatcttaatctgaatttccctggcgctcaccagataccggctggttacgccaaagcgcccgctggcaacctgtttgatggcagagcttctgtcgtgatcggttccggcagattccagacgttcctcactctctccgccctccccgctgttagacttgccgtggagccggttcatggcaaccgccagcgcctcatgggcttcctcagaaatggaaccgtaagacatggcgcctgtcttgaaacgctttacaatggattccacactttccacctcttctatggatatccccgtctgcggataccgaaaatccatgaggctgcgtaaatacccggtattttcctcatccaccagctttgtataggcacagaatttttcatagctgccctcttttgtggactgctgcagcaggtggatggtgcggggattatagcgatgttcttccccctggctccgcattttgtgccgtcccatggaagaaagggtcaaatccgtatccagccccagaggatcaaaggctttggaatgctgttcatcagtctgggccgcaatatcctgcagagtgatgccgcccaccctgctcaccgtctgggtaaaataccggtcaatgacttcactggaaattccgatggcctcaaaaatctggcttccctggtaagactggattgtggaaatccccattttggaggcaatttttacaatgccctgtaaaatagctctgtcataatcttccacagcggcataatagtccttatttaaaaaaccctcttccaccagttccgcgattgtggaatgagccagataaggattgaccgcacaggccccatagcctaaaagagctgcaaaatcgtgtacttctctgggttcccctgattccaggatgagggaaagcgctgtgcattttttcgtttttaccagatgcttgtgtaccgcagaaacggccagcagggaggggattgccacatggttttcatccacgccccggtcagaaaggatcaggatattcgctccttcccggtaagccttatccacttccacaaacagatgctccaacactctgtctatgggagtgcttttatagaaaataattgggacacaggccacctgaaagccgggttttgtcatctcttttatttttaaaagatccagatccgataaaattggattattgattttaagcacctggcagttctccggtttttcttccagcaggctgccgttctttcccacatatactgtggtggaggttacaattttttcccgcaccgcatcaatgggcggattcgtcacctgtgcgaaaagctgcttgaaataataaaacaggggctgatattctttcgacaggacggccagaggggtatccacacccatggcgccgatttgctccgtgccgtttaaagccatggcgcagatgccttcccggtattcttcataggtataaccgaaggacttctgcagtcttgcgcgttcctcttttgtgtaggagggaattttctcattcggaattttcaattcctgcaaggtaaccagattgctgtccagccattccccgtagggttccttttttgcataatattcctttatttcctcatcgcttaccaccatgcccctctgcgtgtccacaagaagcatcttccccggatgcaggcgttccttcttgagaatgttttccgccggaatatccagcaccccaacctctgaggaaagaatcagccggtcatcatcagtgatgtaataccgggagggccgaaggccgtttctgtccagcaccgctcccatcagatccccgtcggaaaaaacgatggatgcagggccgtcccagggctccatcatagtggcgtagtattggtaaaaatcgcgcacctcctgggaaatggtatcgttgttggcccagggctccggaatggtgatcattgccgcaaggggaagctccatgccgctcatcaccagaaactccagcgtattgtccagcatggcagaatcggagccgcctgtgtttaccaccggaaggacctttgtcagatcatccgccaaaaatgccggcgcccgcatggtttcttccctggccagcatcttatccgcgtttcccctgatggtgttgatttcaccgttatggacgataaagcggttgggatgcgctctctcccagctgggatttgtgttggtagaaaagcgggaatgtacgatggcaattgcggactcatagtcctcgtcctgaaggtctgtaaaaaaggtacgcagctgtcccacaagaaacattcccttatacacaacagtccggctggaaagagaaggcacataggtattattgttgctctgctcgaactcgcggcgcaccacataaagacggcggtcaaaatccagtcctttttttaactgttccggcttttttacaaagccctgacagattacaggcatacattttctggccttatgtcccagcacctcaggccggatgggaacctcccgccaccccagaaattccataccttctttttccacaatgatttcaaacatctttttggcctggctgcgtttcagttcattctgggggaagaaaaacatacccacgccatattctctttcaccgccgatatgaatttgggcctgcccgcagacctttgtaaaaaaacggtgagaaatctgagtcagtatgccaacgccgtccccggttttgccttctgcatccttcccggcgcggtgctccagcttttccacgatttttaaagcatccaccactatctgatggcttttcctgcctttaatatgaacgacagcgccaattccgcagttatcatgttcgaatgccggactgtaaagatcctgttgtgtttgtatatgtttcattattattcctcctccttgacggtagtgtattccacggctgcggcgatcaggccccggaaaagaggatgggcatgattcggccgcgatttaaattcgggatgggcctgagtggcaataaaaaaaggatgtttctccaactcaaccatctccacgatccgtccgtccggcgacaatccggaaagacacatacctttttggatcagacattcccggtatgcattatttacctcataacggtgtctgtggcgttctgaaatttctttttttccatacagcctttgggccagtgtcccatccttcaatatacagggataggagcccagccgcatggtgccacccagattaatcacattattttgttctggcatcagcgcgatcaccggacatttcgtatcaggatccagctccgcactggctgcatcaggcagtccggccacatttctggcaaactctatgatggcaagctgcatgcccagacaaattccaagatagggaactttattttttctcgcatattcgatcgccaggatttttccctctgttcccctctgcccgaatcctcccggaaccaaaatgccgtccgcatcatgcaaatatccctccagattttcaggtgtaagctcttcagcatcaatccagcggatattcacatccgcccggtttgcaatgccgccatgttttaaagcttccaccacgcttaagtaagcatcgtgcagccccacatattttcccacaagggcgatcgtcacagaggtacagggatggagcagatcctctatcatcgccttccagccgttcaggtccggcactggacagggcagccttaaacattcacagacggcctgggccagtttttccttctccagcatcagcggcacttcatataaagagggagcgtccatattttgcagcacctgctctttttttacgttacaaaacaaagcaatcttttccttcattttttcatccaccggataatcggagcgacacaccagaatatccggccagatccccatgccctgcaactccttcacactcatctgtgtgggtttcgttttcatttcaccggaagcttttaaataaggaatcagggttacatgtatgagaatcgcattttcatgtcccatttcatgttgaaactgacggatcgcttccaaaaaaggctggctctcaatatctcctacagtcccgcccacctctatgatggaaatggtctcctcctcaggggaactggcccgataaaaacgggacttgatttcattcgtgatatggggaatcacctgaacggttccgccgccgtagtccccccgacgttccttatgcagtaccgaccagtatatctttccggtggtgacgttggaatttctgtcaaggctttcatcgataaacctttcatagtgccctaaatccagatctgtttccgtaccgtcatctgtcacgaatacttccccatgctggatgggattcatggttcccggatctacattaatatagggatcgaacttctgcatggtaatgtggtaacctcgcgccttcagcaggcgtcccagtgaagccgccgtgattccttttcccaggccggacacaacgccgcctgtcacaaaaacatattttaccgccatactctcctcctgccctgtatgaaaaatctacatatataaaaaggtgccaaagagcccgcatctgcaagctctttgacacccttgtcaacctgtcttattctatctcttaacaatgtttttatgcgtttcaatataaactaatacttttgatttgtaaagacttttttcaaaaatttttcatggagcgttactgttcacaccccatttgggtccctgccaccgccgccctatggccgcgcctctgtgtccaccagccggcttagatgttgtttcttagagggcacgctttcgctcgattaaaaacgcaacggtactaacgccgcaaaaaacgcggcgtaaggaccggcgtttttagacgacccttacagaaaacaacatctaagccggctggtggacacagaggcgcggccatagggcggcggtggcagggacccaaatgtggtatgaacagtaaccctggagcaggttctgaaattttcaaaattttttcttgacagcctgcaaaaacaggagtatgatgcgaaccataaagcaaaggcgctttggaagaaatccttccagagtgccttttttttactataaaccgaaaggagaaacttttaatgacaaaaggaattcccgaactttacggcagcctggtttttaataacagggtcatgcgcgataagcttccgaaggatatttacagggcgctacgcaaaaccattgaaaataatacgcatctggagctggatgtggccaactctgtggctgtggcaatgaaggagtgggcggttgaaaacggtgccacccacttcacacactggtttcagcccatgaccggccacaccgctgaaaaacacgacagtttcattacccccatcggcgacggccaggtaattatggatttttcaggaaaagagctggtgaaaggggaaccggatgcatccagctttccttccggcggtttgagggctacctttgaagcaaggggctacaccgcctgggatcccacttcccctgccttcattaaagacaggacgctgtatattcccaccgctttttgctcctacagcggagaagccctggataaaaagacgccccttctgcgttccatggagacacttaataaggaagcggtaaaaattttacatttgctgggcaaaaacgatgtgaccagcgtttccacaaccatcggtcctgaacaggaatatttccttgtggacaaagccctctatgaaaagaggaaagatctgatctttaccggaaggacactgcttggcgcaatgcctcccaaggggcaggaaatggaggatcactatttcggcgctttaaagccccgtgtatccgcttacatgcatgatttggatgaagaactctggaagctgggcatcccggccaagacaaaacataatgaagtagctcctgcccagcatgaactggcgcctgtttttgatacggccaatatagccgtggaccataatcagcttaccatggaaatgatgaaaaaagtagccgacagacatgggctggtatgtcttcttcatgaaaaaccatttgaaggcatcaatggttccggcaagcacaacaactggtccatgatcaccaataccggcgttaacctgctggatcccggccggactcccgctgaaaacattcagtttctcgtctttttgatggcagtcatcaaagcggtggatgagtacgcggatctgatgagggtttctgtggccagcgcaggcaatgatcacaggcttggcgcaaatgaagcccctccggccattgtttccatttttcttggcgatgaactgacagctgttttaaattccattgaaaacgacactttttttggaaagcagcaaaagatccaaatggagaccggcgctgcggtactgccccattttttcaaggacaacactgacaggaaccgtacctctccctttgcttttactggcaacaagtttgaattccgtatgctggggtcctccatttccgtcgcaggtcccaacattgtactgaataccgccgtagcggaagccctccgccagttttatgaagaattaaaggacactccctccgaccagatggaggaagcggttcacggtctggtaaagcgggccattttcaatcataaaaaaataattttcaacggcaacggctatacggaggaatgggtaaaagaagctgccgcacgagggctttataacttaaggtccacttctgaggcactgccccatttcatcgctgaaaaaaatgtggcgctctttacgggacatcatattttcacccgggaggaaatttactccagatatgagattctgttggaaaactattgtaaaacactccacattgaagcaaagaccatgcaggatatgatctgcagagaattcctgcctgctttgatggaatacacagacaaaatcgccagttcccttcgtgctaaaaaggcccttcttccggaactttcatgcagctcacaggaacagcttctggaaaagctctctgtatattatgaagaaattttccgggcggaagaaaaactggaagccgatacggccaaagcggaagcattgaccgaaatgcaggaagccgcggtattttattatgaaacggttctctccgatatgaatgcgctcagaaaagcagcggattctgttgaaaaatatcttccagatgagattcttccttatccgaactatgaaaagctgttattctccgtctgagcaaaggaaagggaaagtggcacaaaaacgatgaataatcgatgtgaagaatttgataaacccaaagaagaatgcggtgtattcggtatctatcataccgatggcagcgccgcagcccccgatgttgcctgggggctgtgcgctttgcaacatcggggacaggaagcctgtggtatagcggtatgcgacccctgcggccccaaggggaatatctcgtggcacaaggatacagggcttgtaagtgaagtctttcatactgatattttggaaaaacttaaggggagtgcgggcgtgggccatgtccgctattctactaccggggcaagcaccgctgaaaatgcgcagcccctggtattaagttacctgaagggaacgcttgccctggcccataacggaaatctgatcaatgcgcagaagctggcgcaaaaactccaggaagaaggcgctgttttccagacgacaacggattccgaagtgattgcctgctatatcgccagggaacggacacacacctcctgtgtggaggatgcgatactgcagactgccagaaagctgaaaggcggatatgcactggtcatcatgagtcccagaaaattaattggtgtgcgggatcccctggggctaaagcccttatgcctcgggaaacgcggaaacagctatatccttgcttccgaaagctgtgccctgaccgcagtgggcgctgactttatccgcgatatacaacccggtgaaatcattacgatttcaaaagatggggtccggtctgaccgccgtctcgttcaggaaaaacatgcacactgcatttttgaatacatctatttcgcccggccggattccatactggatggaatcaatatctatgacgcaagaatccgtgccggaaaggcgcttgccgcttcttatcctgtagatgcagatctggtcaccggagtgcctgactccggcatcactgctgcaatgggatatgcacaggcctccggcctgccgtttgcctttgcattttataaaaacagttatgtgggaagaacttttataaaacctacccaaaaggaacgggaatcagctgtccatctgaagctgagcatactgggaaatgtcgtcagggataaaaggcttgtcctcatcgacgattccattgtccggggcactactatagcaagcctgattggtatgctaaagaacgcaggcgccagagaggttcatgtacgcatcagctccccgccctttctattcccctgttactacggaaccgacgttcccagcaacgaccagctgatcgcttcttcccgcacagctgcccaaatctgcaccgatatcggcgcagattccctcggttatctgaaactcgaagatctaaaacagatgacccgggaacttcctttatgtaaagcgtgcttcgacagccaataccctgtataactctccccggctgtcaggcattctttaaacgcggatacgcccctccgtcagaaagccctgagctttctgacggatatatccgcaaattagatataattcccttataggaacatcgcaaaagcgcgaactcaaaaaaacagagtccgcgcttttgatgtttctgcagtttcacacggcttatgtccggtatgctttcgtaccgccctaaagccgaaaaaaagaatgaggaggaaactattatgactgaagaaattttgagagccatcagcagtgaagtgtatggcgtatggttcctgatcggagccgcgttggtattctggatgcaggccggctttgccatggtggagaccggctttaccagagccaaaaatgcgggaaatatcctgatgaaaaacctgatggacttctgtatcggtacagtaatgttcattttgatcggcttttcattcctgcttggtgaagatttattgggcttcatcggcaagcccggttttgacatcttcaccgcttatgaaagtttcgactggtccaattttgtatttaatcttgtgttctgcgcaactaccgcaaccatcgtatccggggctatggcagaaagaacgaaatttctttcttactgcatctactccggcgtaatctccgccttgatttaccccatcgaagcacactggatctggggcggcggctggcttgcgcaaatcggtttccatgattttgccggttcctgcgcgattcacatggttggcgggatcagcgcccttgtcggcgcaaagctattaggcgcccgcatcggtaaatttgaaagagataaatccggaaaggtcataaaagtaaacgcatttcccggccataaccttcccatcggttgtttgggcgtatttatcctgtggcttggctggtatggtttcaacggtgccgctgctaccagtgtttccgaacttggctctatctttcttaccactacagtctcacctgctgtggcaaccgtcgtatgtatgatttttacctggcttaaatatggaaagcccgatgtttccatgtgcttaaacgcctcactggcaggcctggttgccattaccgccccctgtgatgtaaccgactgctttggtgcaattatcatcggcactgtagccggactgctggtgatattcggcgtatggctccttgattataaactacatattgatgatcctgtaggtgctgtagcggttcactgtttaaacggtatctggggcaccatcgctgtcggccttttcgcgacagataccgctcctgccttttcaagaggcttcggtgacggcgtaagcttcggcgcaaaccagatcgcaggcaccggccttttctatggtggcggttttaaacttcttggtattcagctactggggcttttgagcgttgctgcgtggacattggttaccattacccttacatttataatcatcaaagccttggtaggtctgcgtgtcagcgaggaagaagagcttcagggtcttgatcctgtagagcacggcctggcaagcgcctactccggtttttccatcctggacgtttccaacactatgacgatggatatcaaccagaatacaagccttggcgcttccgattacgaaatggcctccgaagcacagaagaacgcagctatcagcgtcgtaaaacagacctccgctgcagataccgacatacacaaggttgtcattattaccaggctttccagatatgacaagatcaaaaatgcgctcaatgagttgggcgttaccggtatgaccgtcactcaggttatgggctgcggcattcagaagggttccggtgaaatgtaccgcggtgttgaagttgacgccaccctgcttccaaaggtcaagatcgaggttgttgtcagcaagatctctgttgacagcgtagtcgatacggctaagaaaactctatatacagggcatatcggtgacggtaaaatcttcgtatacagtgttgacagagttgtcaaggtccgcactggggaagaggattttgcagcattgcaggatgtagaataataccatatataggatgtctggggggcagaaggtcttttgccctccaggacttttccagggtgaaataagcatgcggggaatttcctgttacttgtaactcgtacttattcgctgtagtattagtttatgctgattaagccacaaatcaaatttcccagtcgacaggtattgattatcaaatctttatcttatattcgggcagcaccttcacgtcataaagttcacatccctcttttaccggcagatcataatataccttatttccataaggattaggaattggtttattactgggataaatacgaattaccaactcctcaggatatccgaatctcttcagtgccatatgccatttttcaccattggtaaaccagtcatcagccagctttccattaatgtaaacctccgcacggtcgccgtcatattctgtttcaagataaagctgatgtacagtacctgccgttaatttttctatttgtatcatatattccttataagccgcacttccatccgtatcctgttcttctctgaataattctgcctttacggaaactttcaccgacgttgcctccagtttaacctgttctggtgctcctgtcacgctatatatcattatagtttctttttcagccttagtaagcagaaactgctgtcctttatcctcaatcaggcagctgtcaggtctctcggtaatatacagatgccctcccgtcagaaaggctctgtctgcctgcgcctttgttaatatcacataatcagcatcttccttttctaactcaaagtacggtctttccaaatctgaccaaaagaaaatacgctttccaagcctgcacagcagcgaagcgtttgtccatgcaggaagaagagataccggcataagctcctttccgttacctgtctctgtgcctccgggaatacggaaaggaaaaacagcgcattctccgccctttatgttgatatgtcccagaattttttcaccgccctcccagacaatgcggacgttgtattccctgtgatcatccatcctgcgtttcctttgatgattattcacaaacaggaatcccaatccgtctgaaatatttactcttgccgccatccgcagggtatgacagtcgtctgccgattccggctgcttctgtgcgaaataagtatctgctccggctaaaatttctccaaatgaagaaataaataaatgaagttttttcaaagctccaaagcttgtgttgatttctccggattcccgaatacaggtttggaagtcatagctttttatcggaagatcgttattatatccggttgccctggattcctgaagcgtactgtatttcccgtccggatttattccgccatggtacatatagtagcccaggagattggcaccgctgcccagcatacataacgcctgcgcctgtatatcctccggccagggatatgttcttctgtgactcgtcacctgaagtccgcctcccagctccgctgtcagataaggattcttatgtatattaaaggtaaaattgttctcttcttttttactgaagtcggagccaatcgtatcatccattttgtaagaagaaaaaataaaattggtattggcaggcatttcctgcacatgatccgcccagggtgcgtccacatatccacccagtaccggaagcgcttcaccatccggtacataagcgccgccccagcctgtggcagtatagtaaggaactataaaacctgccgcctgcgccatttttttcagggtcagcatatgtgccattccttctttactgtctgacggtccgccgcagtgtccatactcgttttccagctgaactcccagaaccggccctccgtccatgcacatcattccttctgcctgttctcccaactgcttccagaaacgctccacgcgtttcagatatacaggatcattaatacgtacaggggctccgtcttttataagccagtccggaaaccctccgtttcggcattctccatgtgcccaggggccaatacggagccataccggcattccgatatccctgcatatttgtaaaaagcctctgagatttctgcatcctgtaaaatcccattcaccttcggcttcctcatggtgtatccagaatacataagtagcgataatagccacaccgcctgcacgcattttcagcagctcttcttcccatgcctccggctcataccgggaaaaatggaattctcccattataggaataaaactcctgccatttttcataaagctgatattgtctacttcaaatctattgccggccttgtcccttcctcccataggaagaagcttatctcctttttcaaagttattctttataatttgaatcgtattttccacttttttaccctttcacacttcctaaagtcagtcctgccgtaaagtatttctggcagaacggataaataaccatcagagggataatggaaataaaaatctgagcagccttcaggtttttatcatttacactcagtgcatttactatatcttccatattcccgctctgaataatggaacgcatatccactaccatggtctgaagataggactgaagcggataattatccgtaaaattagaataaatcagtccgtcaaaccagctgttccaatggttaatcagggaaaacaaagtcaccgtcgcaatagagggtttagataaaggcagataaatcttgctcatgatagtccattgtcccgcgccttccaacatagctgattcctccagagattcaggaatgcctctgaagaaattcatcatcaatatgacattaaaaatcggcacgccgcagggaagcaccaatgcccagattgtatcgatcagtcccagtttggaaattacgtagtaggtgggaatcaaaccgccgttgaaaatcataaggaacacaaaatatgctgaataatatttccttgccttaaaaaccctgtcgcttttagacagcgggtatgccgccagaaccgtaagcagcatattaatgggaacccccaggagcacacgttctgcagaaactaaagctgcctgccagaaatccttgtttttcataacataggaataagcggatgtggtaaattccacaggaaacagccttactttattttgaacaattgcatgggaactgctgaacgactgcgccaatacatttaagataggaaccaggcagattaacataataagagtaataacaacaacattacatatattaaataattttcttgccggagaaacttttatttttttcattgacctttatcccttccttctcagaatacacgatatccggcaaatttatctgccagcttataagaggctacaatcaggataccggaaaccaccgatttaaaaaagcctactgtggcggaaagcgaatattgctgattcacaagacccaggcggtaaacaagtgtatcaataatatcacctgtagaataaacgcttgcactgtacaggttaaaaatctgatcaaatccggcattcaaaatatttccgatggaaagaaccgtcatcagggtaataataggcgcaattcccggaatggtgacatgaatcgtctgtttccatctgccggcgccgtcaatggcggctgcctcatataaaccgggatcaatccctgtcagtgccgccagatatacaatggcattatagccaaagtttttccacacatccgtcagaatcatcgtccacgggaatatgttcttatcccccaggaaatttaccggttctccaatcagtccaatggtctgaaggaacatgttaaaaagtccggtgtcacttttggtatttccctgtgacagaaagtttatcagaatacctgacagaacaatccaggataggaagtagggaagatatgttgccgtctgtacggtctttttaaataatttatttttaatctcgttaagcatcagagcgaaggtaagaggcactgcaatattgccgataatctttcccaaagctatcatcagcgtatttctcaatgccggaagaaaatcgggcagataatagattgttctaaaattatcaaagccgacccactttgactttaagaagcccagccccggctggaaatcctgaaacgccataaccagaccaaatatcggcagataattaaaaataaacagcagcaaaactggtaaaaaaagcatcatgtggaatgccctctgccgggatcttgctgaattactcatgcgttgtttcttttttctcataaaccatactcctcttttaaaacaggaggcataagtaaaaacttatgcctgcctgcgttttcccttaatgattctggtcgtaccattcctgtgcttctctggtaacttcggttcccccaagtgcctcccaggattgtaagaaggtgtcgtagctgtcaacactgtcccctgatataatttttacaatagtctccagggccagcttatccagcgtggaaaattttgatgacattgtttctgtaggaatatagttatagaccgaatagttataattattatctttaatcagatccaccatagtaattccgcctcccaaatcgtctccggatacggtccacattcctattccagccagaacatcgggatcctccgcttccagtttttcaataagagtaccatcctttactgctgtggtataagcttccatattagtcacatcaattaactgggactgggtcagtccctctttatttccagtttttattgcttcatgttcttcatcgatattttcaacagcctctccctgagaagtaagctgaaccagacatgctttccagccgctgtatacgccgccttttcctgtatacatatcatactctgtctcatcttcataatagcaaagtttatccacactcagattgcacagcttaatcagtgcttcaggattcttgcatttgctgctgattacaaaataggttccgggggttgtcgggatataaggcttagaagacccttctcccataccgtcaggaatctttgcggatacaatacgtgcttcaggatttgctttaaccgcatcaacaacaggcaccatagctccccagcggggtgcaaaataaataccgcatcttccggctcccacatcctgggtaatctgattataatccattgtaccaaagttctttgccagggagccgtttgcatacatctcctgaagatctgcaagccctgctttcatttcctctgccagggaaccgccccatactaccttgccgtctttttcaataaaagtaaactgcccgttccaataaccgggagctgcaccatagccttcaaagaaagcttggattcctgaccagtaattaaagccttctttaccgtttaacgccagtccgtatgtatcatctaccccgttgccgtccggatcctgttctgtaaatgccttggccaccgcttttaattcctccatggtagtcggtatttcaagattcaggttatcaagccagtcctggcggataaacatcatcatcgcatcgccacgatagtcatttacctgaggaatcccatataattttccgtccacctttgccgcattcagcgaatttccgtctccccatgcctgatattccctaagctgatcagaagcatatttttcataaacctccgtgatgtcagcgattacacctgtctgcgcatacttaattaaatctgagccgctgacagccatgatatccggatagtttcctgatgcaattgcagtggttcttttcgtctcctgctgggagccatccacgttatacatgatatcaagattgattccgttttctttataaaggttataccaggtattattatctacactttcatcaccctgccactcaaaatcagaattaaaggccagcccgactttcagggtaatcggatcctcatatccataaagattcagttcacccgaatccaccgtatccgctgcagtctgggatgcctccgtctgcactgcatcgctctgcgccatattagtactgtttgccgtttcggcactgccgcaggccgcaagcccggttacgcaggttactgcaataaaagccgccaaaaacttctcaaaccatttccttttcatttctactcccttctgcacgttatacgcacatgtgttttttgatttgctctacaacaaaaattatatagaaaaatttttctctttctatttacaatattttactttcataacatttctttaccaaaaaggcttatacatggcattactttgccggtaatgccatgcataagccttttcaattgttgcagtttaaccttctcccctctggcccggtcttctttccccgatccgcccggttctgggactctctgtcattttcctataaatattttgataacgatatgcgctccgccaagactgcttcgacttatttcaagcccgcttttttcaccccagtacaacttaagacgcttatggatatttataattcctgttatttcatcggttttctccagtttttcccttaattccctcaaagtatcatcagtaaacatctgcccattgtcttcaacatgtatctccagaatatcctcctttggccggaatgtaatacgtagcattccgccctcttccttttcttccaggccatatttcagagcattttctattactggctggagaatcagcctgggaaccataacagattcatattccttcggaagttcttcaaaataaacattaatccgatcatgaaatctcatatactggatatctgtatagcttcgcgcatgctccacttcactttttaaagaaatgcagttttcatcattcctggtaaggaaccggaaataagttcctaaaagagaagccagcttctccgcatcttccagctcttcccgcttaatcttatttttaagagaaaaaaagctgttatacaaaaaatgcggattgatctgcgcctggagctgcttcagctctgcctgctgagcaagttccttctgcaaaaccagttcttctatcaaacgcttcgttttatcctgcatatgattaaaaccttcaaacaaatagctgaattcatcctcacctgtgtattccgtcccgccagagctgaggttttccttttccacttttgaaaaggcttccatcagtttatttaatggcctgtgaatggtcttttctatactttcagaaaatacgactgccactgaagctacacctataatataaataaacacgagccatttatagctttccatgtttttaaggacttctttttccggtgcatactgtacaaaatatcccagatatgaagattgagtaaccgatatctggtaatttccctcttccgttttaataacatcggaaaattcttccttctcctcaagttcaggccgcaaaagttccaaaattctgttccccgttcccgcattttctccgctttcaataaaaatactctgttcaggctggtataggaaggaaccactgttatctattgtattaaaattccgcagtgtctcttttatctttttttcgttaaattctaccacaaacaaaacagccggcaattctctggtctgatataccggcacaccggaggatgacataaacaaggagccctccatatatttcaaaggaaaatccgacatagtatatttctgccttacagcctcaaagtcatcagcatccatatctgtaatataggaatcagatatcttcatcttcgcatttggaagataaataatgcccgaagctaccagcgggttattttccttcagcattataatccgttcctgttccgacaggtaagcatccctcagttcgtaggcattaagaagattggtatgttcgaccagaaaaataagttttctatcggaaaacatattgtagagcatattttccgtactttttaaatgattatctatagtttccagataaaaatcagcttgagcgtccattttgtcaaaaatggattttttcaccgtagcagtagccagaaaatacaaaaccatggaaaataatacattgacagccataaaaacagcaaaaataatcagttgttttgtccggattgattttttgcatccgataccctttatcatacttttacccaatttcttatatatcattatttttttctccgtatctgtcacgatactctactggagatatacccaccgactttttaaaaaccctggtaaaagaaggtgccgtcagatatccaacgcggacagaaatctcattgattttacaggctgtggtcgtaagcagtttttttgctttttccagcctggcattacttatatattcagtgatgttgcagccatatctttgcttaaatattctggaaagataggaggcattcaggtaactgatttctgcaagcctggtcagcgtcaaatcctccgccagatggttatcaatatacagcagtaccttttccagtacatcattggttctgctctttctttccgcatccatttcatctgcaatagcaccggctacagcctgcagataattggcagcctctctcatgcctgcgtgcttttctacgtaaattaacttatccagagggtaatccgaccctattttgtttttaatatgatttatattaatataccgaagtaaaagaatcgcaatactataatacagctccgttgccttcagtgtatcttttttatcctccacacatagcacgtcggtcagctgctgcagcctggtcataaagtcacgaaatttttttgtttcaagggcttcctccagccgctttacctgcagctgaagatttaccggcgcattatcctcaagaagccctgaggctaacggagcagactctgccataatcgttctctgcacattgttcccaatcctgtcagcagcctcctgcttcagcctgttcaaataagactgtccgtctctcaagcggcatctctcatcacaggtgacaaaggaaagcgaaagggagaataagataaaggccttttcctgtacatattccattgcccccgcaagattagtatacagccgcatccaggttcttgccgaaagagaatcctccgggaaacgaaccggctgtaaaaacagaagataatagccattaatatcataatacaggtaataactgattctgggaggcagaaactcttcaattatttcacaaagcgccacctccctttccgtttcctcttcaaagctgatattttcttcaaagttatctgcccgtaataaaaaaataaacaaatccttatcaaatcggagaggtattttaatacgattaagttcttcctgcgttacattggcggctgctgtattatggaaaaattctctcataacatttttgcgaagaacattctgggcttttttaatttcactctgatgctcactttcctgcatttccgactgcatcattttatcaatttcttcgaaggcgtcagcaactgcagatatcagtacctcatcctcttcacttttcagcagataccttacatccttgtagccgctgatttcatatagattatcaaaatccctgtagccggtcagaaaaatcaccctgcatttcggccagttttctttaatcagcttgaacagctcaataccgttcattccaggcattttaatgtctgtcataactacatcaaattttattttctccagcagcctgaccgcattcgtcgctgattttgccacatagacatctatatccaaaccagattcatacttaaacatttcctccagagattccaaaatatccggttcgtcatccacaattaataaattccccatacagctgccgcctttcaataaaacaagctacaatgcttccgtcaaataccaaactctataatgtattatttatctgagaaaaaataaagtttacttaaaatgtagcatattttatcattataggctataacatgttagcctatttttgtaaaattcttgtagttgatgtaaaagacatgccggccattcagcaatcatattctaaacttcataatacagttcagcaaggtaatagataactcctgaaacaaatctgattcacaaattccatcctttatccctccattctctttctgatttaagataaaaagtgcatgtatgattgacttatttgcctgtattttttacaataaagggagaatttttgtgactgttcagcaggtccgtgcatttactgcacagaccgtaagaaagtgattcaagagtgcaaaaaaacccatctccgcaggcgattttaaatgaatacttgcaaataactgtgaaggtaccgaacagttacgaatttttgatctttcttaccgaatacgccatcattggaaaaggagcgcccacatgcagaatctggtaaaccatattttagcttacctggaatacctggagtctgtgttccagcggaatatcaccattcatgaattccagaaaataacctcgccttatctggcgcagttccttccttaccgtgtccactccaatccctactgcatttatttaaaatcacatcctgaaatctgggatgattgcatcattaaccagcaaaaattattttcattgctggagaacggccctttctggggcgtatgccactgcggagtaacggaatatgtttatcccctgaaacagagcctcccggaagaaaaggtaattggcttcatcagtgtaagcggctaccgcacctgtacggaaaccaccgcaggcaagctgaggcatatctgtgaaaaatatgatttgaattatgaatccgtacacagtttatttaagatgcatctgtcggccgatttgcccgataccaccctgctcgataccttgctttatccactttcctccatgctggaaactctttaccaaaaagaatgcctgctctacggggagtccccggcgcaggcacaagacgcggattatgttcttaaccatatccttctttttattgagaaaaattttcacaggcagatatccattgaggacatctgcgctgccttccattgcagccgttcctatgtcagccataccttcaagtcttccaccggctgcaatttccgggaatatattaacctccttcgaatcgaagaggcaaaaaaacttcttgtaaatacttctttttccattaccgagatatccatgaaaacagggttttccaattccaattatttttctctggtttttcagaggatgaatggaatctctccaaaggaataccggaaaaagtatacgtaaagcggcctatctgccaagcatctgctggagttccttaacaggcacctgtctggggcagattccctctctggtacagattgccgcagcatttccggcggcttctcccagctttacacaaatgggcataacccggtagctggaatgggccatatgtgttccgcaaatatcccggccggccagaagaagcccttccacctttttagggacaaggcagccataaggaattgtataccccttcttttgagtgaattttgcctggcacccggtggcatccagccccgccccggtcaaattatgtacgtcgaaattaaaatgggcatccttcaccgcccagtcctcatgctgcaccgcattttccacatcttccctgcggattgtgctctcccccagaaaatgtcttgtttcccgcacgcctataatagatgcgctgctgataatatagcattcttcatatccaggcacgaaacgccttaaaaatgctacaattgcctccatctgcatccggcagtcccggtgcgccctggccaaatcccccgcactggttccatcggctcctgtgcagttggtcatatttacggttaccacccctggaatcgtggaacggtacagtaacacatgccctgcgggagaaggcaggtttgcttttcccaaatcctgaaccatgccgtccggtacagggatattcgtttcaaaggaacccgggaaaatggctcttttctcatccactcccgccactttgaacatcagggtcataggctgcatctggccgtcctcttcccttcccttataaaaaggcgctcccgctcttgccgctaaatccccatcaccggtgcagtcaatgactgtacccgccatgactgcctccctacctgacttggattccagcagaacgccgcgtatgcggtctccttccataactacatctgaagcaaacgtataggtacgtaccagcacccctgcctcctccagcatctcaagcaacacgtttttcagcttttccggattgatagtctgccggtctccattgcgttcatcgtccctggaacggtccagaatctcttcatacaacccccctctggtctcccctgtccaatggctcatcatgccggtggtggccactcctcccacatctccggcctgttcaatcagcatggttttacatccctgcctggcggcggcaaccgccgcgccgataccagcaggcccgccgccagctaccagtacgtcaacacggtcagtgacaggtatctttttttccggctccacataatattccatagtaatctcctttgcatacttttaatatttttttgcttcttccataaaaatatctctttatttgtaagttttccttcataaacgggcattatttctataaaaaaatgcatgcatgattatccaatttatctgtcaattttacaagaaaagaaacttgcagttacggcttacgcaaatcagcaaaaggctcatattgtacctcttccatcttcaatgcaaacctgcggaaccacttttaccgcttttatccttcttcccccatgtatcccgattgatatcgctgtggctttcctgtttcccaggcagaaaacctatccactccaaatcccagttatcagcctcaacctcttggctgtttttagtatctgcagctcactggccccatcgatttctgccgcttccatgaggctttcaggaagactacctgtagaaaataaaaaaggactcttcccagcgcaagctgaaaaaagtcctttcaaataaaaaaatgcgggtagccggacttgaaccggcacggtatcgctaccgagggattttaagtcccttgtgtctgcctattccaccatacccgcagaatatataacatacaataatacaaataaactttaaaaaaagataagcaccgccaaccggcaatgcctcttcctccgttctttttacactaataaaaagaaacgacccagatcggactcgaaccgacgacctccgccgtgacagggcggcgctctaaccaactgagccactgggcctaactatacagcttacaacaaaatggaccttcggggactcgaacccaggaccgatcggttatgagccgattgctctaaccaactgagctaaaggtccgtaaatatttacggtaaatatttaaataataaaagccgatgatcggactcgaaccgataacctgctgattacaaatcagctgctctgccaattgagccacatcggcaaataaatctacttacaacaaaaacgcatcggtcaactacactgctgcgtctttcataaacaaatgactccgacgggaatcgaacccgtgttaccgccgtgaaagggcgatgtcttaaccgcttgaccacggagcctcttttcctttttggattcccttctccaggtctcctttgtggagattcctctccttctttcgctcctccggacttaagccttcacagcacctccccgagtagggctcgaacctacaacaactcggttaacagccgagtgctctaccattgagctatcgaggactacctctttcctctacatctctctataaccagatgtatgaacccataccctcaaaaccgaacattgaatctaatctcttctctctccaaaacctgcttctttcaggataagccctcgaccgattagtactggtcagctacatacattactgcacttccacctccagcctatctacctcatactctctaaggggtcttacttattgggatatctcatcttgaggggggcttcacgcttagatgccttcagcgtttatccctgccggacttggctactctgccatgacgttggtcgtcaacagatacaccagcggtccgtccatcccggtcctctcgtactaaggacagctcctctcaaatatcctccgcctgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagtcctactttcgtacctgctccacccgtcggtgtcacagtcaagctcccttatgcctttgcactctccggatggtttccaaccatcctgagggaacctttgagcgcctccgataccctttcggaggcgaccgccccagtcaaactccccgccagacattgtcccccgcccgggtcacgggcgcaggttagaaatccaatgctgcaagggtggtatcccaacattgactccatgattactggcgtaatcacttctcagtctcccacctatcctgtacatacagcatcgaatcccagtatcaagctggagtaaagctccatggggtctttccgtcctggcgcaggtaaccagcatcttcactggtacttcaatttcaccgggtgcattgtcgagacagcgctcaaatcattacgcctttcgtgcgggtcggaacttacccgacaaggaatttcgctaccttaggaccgttatagttacggccgccgtttactggggcttaaattcggagcttcgttgcctgactcctcctcttaaccttccagcaccgggcaggcgtcagcccatatacctcacctttcggtttcgcatagacctgtgtttttgctaaacagttgcttgagcctattctctgcggcctcctttcagaggcaccccttctcccgaagttacggggtcattttgccgagttccttaacaatgcttctcccgccggccttaggattctctcctcatccacctgtgtcggtttacggtacgggtatcatatgaacaatagcggcttttctcgacagccggcccgcctgcttccctactctaattcggtacgcatcacggcttcagattgccagacggtttttccagtctgactcctactccgcttgcaccggttttccctttcccggctcaggctttccttctgtgtccccacagttctgtcatatgatagtacaggaatctcaacctgttgtccatcggctacgtctttcgacctcgccttaggccccgacttacccagggcagatcagctttaccctggaaaccttagatattcggcctggaggattcccacctccatctcgctactcattccggcattctctcttcttaccagtccacaataccttacagtactgcttcgtcccggtaagattgctcctctaccaatacaattacttgtattcctaagcttcggtgtcgtgtttcagccccggacattttcggcgcaggacctctcgactagtgagctattacgcactctttgaatgtatggctgcttctaagccaacatcctagttgtctttgaaatcccacatccttttccacttaacacgtactttgggaccttagctgtaggtctgggctctttcccttttgactgcccaacttatctcgtgcagtctgactcccgtacatcatacctatggcattcggagtttgatattcttcggtagactttgacgccccctaggaaattcagtgctctacctccatggcattaatacgaggctagccctaaagctatttcgaggagaaccagctatctccgggttcgattggaatttctcccctatccacacctcatcgccacccttttcaacggatgtgcgttcggtcctccattgtcttttacgacaacttcaacctggacatggatagatcacccggtttcgggtctgcagatgctgacttcacgcgctattgacacttggtttcccttcggctccgtcccttaaggacttaaccttgccagcacccgcaactcgccggaccgttctacaaaaagtacgcggttgtacccctgaggtacttccacagcttgtaaacacagggtttcaggttctctttcactcccctcccggggtccttttcacctttccttcacagtactatgcgctatcggtcactaaggagtatttagccttacggggtggtccccgcttcttcccacaaggtttctcgtgtctcgtggtactctggatactgctgtcctcactcggttttcgcttacggggctttcaccctctctggccggtctttccaggaccgttctgctaaccttgttcgtaacgtctgcagtccgaaccccagcatgcacgcacactggtttgggctcttccgttttcgctcgccgctactcacagaatcgatatattttctttctcttcctccggctacttagatgtttcagttcaccgggttccctccgcatacctatggattcagtatacggtgacggaggtttgctccgccgggtttccccattcagacatctgcgggtcacgggatatttgctcctcaccgcagcttttcgcagcttatcgcgtctttcatcggctcttagtgccaaggcatccgccctgtgctctttacagcttaacctgttgtaactcgtccttttttggtctcgttaccagcatacatagcgttgtatgccttttatttgaaatcttcatttcttttttgcttgttttggatgtcttctcgtttatcttcttctatccggttggttcttacaaaccaactttttagacgttgatactttaagattattttcaatattcggttttcaaggtacggattcttatctttggatccctttttccaggtatccagtggagacggagagattcgaactcttgaccccctgcttgcaaggcaggtgctctcccaactgagctacgcccccatttaatctggcagccacctgctctcccataccgtctccagcatagtaccatcggccgcttaagtcttaaccatcgtgttcgggatgagaacgggtgtttcccttaagcgcatcgccaccagaaattaaatgatgctttccagatgcctttcggcttccttaacatctaaacagtaatacaacccttacttcttcgccttagaaaggaggtgatccagccgcaccttccgatacggctaccttgttacgacttcaccccagttattagacctgccttcgactgctcctcccttacggttaggtcacaggcttcgggcatttccaactcccatggtgtgacgggcggtgtgtacaagacccgggaacgtattcaccgcgacatgctgattcgcgattactagcgattccagcttcatgtagtcgagttgcagactacaatccgaactgagacgttatttctgggatttgctcaacatcactgtctcgcttccctttgtttacgccattgtagcacgtgtgtagcccaaatcataaggggcatgatgatttgacgtcatccccgccttcctccgggttatccccggcagtctccctagagtgcccagctttacctgctggctactaaggataagggttgcgctcgttgcgggacttaacccaacatctcacgacacgagctgacgacaaccatgcaccacctgtctccaatgctccgaagagaatgccccgttacggacacgtcattgggatgtcaagacttggtaaggttcttcgcgttgcttcgaattaaaccacatgctccaccgcttgtgcgggtccccgtcaattcctttgagtttcattcttgcgaacgtactccccaggtggattgcttattgcgttagctgcggcaccgatgggtccatacccacctacacctagcaatcatcgtttaccgcgtggactaccagggtatctaatcctgtttgctccccacgctttcgagcctcaacgtcagttacagtccagtaagccgccttcgccactggtgttcctcctaatatctacgcatttcaccgctacactaggaattccgcttacctctcctgcactccagcctggcagttccaaatgcagtcccagggttgagccctgggttttcacatctggcttgtcatgccgtctacgctccctttacacccagtaaatccggataacgcttgccccctacgtattaccgcggctgctggcacgtagttagccggggcttcttagtcaggtaccgtcattttcttccctgctgatagagctttacataccgaaatacttcttcactcacgcggcgtcgctgcatcagggtttcccccattgtgcaatattccccactgctgcctcccgtaggagtttgggccgtgtctcagtcccaatgtggccgttcaccctctcaggccggctactgatcgtcgctttggtaggccgttaccctgccaactggctaatcagacgcgggaccatcctgtaccaccggagtttttcacactgcttcatgtgaagctgtgcgcttatgcggtattagcacctatttctaagtgttatcccccggtacagggcaggtttcccacgcgttactcacccgtccgccactaagttacgccgattccatccgaaaacttcctctgcataactccgttcgacttgcatgtgttaggcacgccgccagcgttcatcctgagccaggatcaaactctcttgtttaagtgtttaacccagttaagattaactctagctaatgtttaaccgttgcttgtttccaagcgtttcttactgtttttgggtgtcttaaaggtcttcttacgaagctttaaaacttgttctctgaattttcttttttagaattttcagggttgcattactgtttatttgtcaaggttcagcgttctgctttctcagccgcaacagttgatatcttatcacatgttgttttgactgtcaagcacttttttcaaaaacttttcttgcagcttttccggtatatttatcggattgctgcgaacggagaaggagggatttgaaccctcgcgccgctattaacgacctgcaccctttccaggggtgtcccttcggcctcttgggtacttctccaagtaagctgattcaatcaacttgtatttatttgtatggcatcccgaaaatcattcagtctgatttccgcagcgaaacaatcgctaacggagagggtgggattcgaacccacgcgcccttgcggacaaacggttttcaagaccgcctcgttatgaccacttcgatacctctccatgtttttgtttaaaacgatgggtcgttccgaatctcttccttctttatatagaagaaagtactaacgctttgccttcatggaaccttccgtttgttcagaagtttgtgttcctcagcagtgcaaaagttattatagctaaaaagcccctcagtgtcaacacattttttcagaaatttcaaattattttttcaaaagtgtaattttccttgtatttactgcatatatggggtatgcattgtcgtttttttctgcaaattcagactcttttctctaaaataccgtctgccaaaagtaaatcctccggggtcgtcagcttaatattctcataggaagcccggaacagctttaccggatgggcaaggagtgtttccaccaccatggcgtcatccgtgatctgaaccccgctttcacgaagctcctcttccttttccagaagcatgcggtatgcatttttaatcaaatcggcactaaatacctggggggtctgcatcatccagacacgatcacgccttggcgtggatacggcaaagtcattctcatccgcgatttttatggtatccttcaccggcattgccgccacacaggcatggtgcacccttacggtttcaagcgcagtctgaagaatctcctctgtgacaaaaggcctggccccgtcatggataaatatataggcacagtcctccgaaacggcttccagcccattcgccacgctgaaataccgctccgctccgccgggcactatctttcttactttcgtaaaatgatagcgctctacgatctcttcgcggcagtaagcttcttctccctgttcggtcaccagtatgatttcatcaataaagctgtcttcaaaggctttcagggcataataaataaccggcttttcccggagcatcatatactgcttcgggatatcactgttcatacgttttccttttccggcagccagaactaccgccgctgttttttcccgcgcgttttccatagcgttatcctgccttaactgattctttctcccagcttcaggttgggaaccgcattgagatcccagccatgtctggtgccttttatgtattcatagtatcccgccacacctatcatggccgcattgtccgtacagtaaatgggggagggatggtaaaattccagcccgtttttccggcaggcttcttcaaaggccgcccgcagggcagaattggaagcgacgccgccggctatggcgaactttttcaaatgatattgggatacggcttccatggaatggcctaccaggacgtcgatcaccgctttctggaaggatgccgccacatcagcctggcagatctcaatccctttcatctcacaggaattgaggtagttgagcactgcggatttcaggccgctgaagctgaaatcataggtgcttccatccaccttggccctggggaatacaacagcgtccggatttccttccctggataccctgtcgatcttggggccaccgggatatcccaggcctatggccctggctaccttgtcaaatgcttctcccgccgcatcgtccctggttcttccgatgatttcatattcaccgtagtccttcaccacaaccagatgggaatggccgcccgataccacaagacagataaagggaggcaccagatctttgttttctatataattagcgctgatatggccttcgatatgatggactcccaccaacggtttgccggcagcgaaggcgatggcctttgccgcagaaactcccaccagaagagctcccaccaggcccggaccataggtgaccgccacggctgtcacctgctgcagggtaattcctgcgtcggaaagagccttttcgattacctggttgattttttcaatatgctttctggatgctatttcagggaccacgccgccgtagagggtatgcaggtcgatctgggaatatatcacattggaaagtacttctctgccattgcggacaacggaggctgcggtttcatcgcaggagctttccacagcaagaatataaatatcttctttttccataatgctttcaccttttatactactgattataacagcccggacagctcctggctgctactgctgttcctcctcaaaaaggagatcgatactttttccgtctttcccagctattgcctgggggaatattttacggacgccatccatgtagtcctccggcctgatgagggaggggctgtaatgagtaagccacatctgttttacctgggcgcgcttagccatgtcagcagcttccaggaaggtcatgtgcttatactcctttgccttttcctttttctccggctcgccgtacattccttcgcagataaaaagatctgccccggcggcattttttacaattccctcggtgggccttgtatccgtacaataggtaagcttgattcccttccggggagggccgagaaccatatcgggagtcaggaggccttccggcgtctcaattgtctcccctttctgcaggcggttccagtactgtttgggtatccccaggctttgcgccttctccaaaagaaaacggccgccgcgttctattacaatattatagccatagcagatcacgttatggttgacgcggaacgcctcaatacggaagccgtcaaaggggatggactgctcgttctccgtaagctccatgcactcaatggcaaacggaagctccggcgcgatgacgcgcagggcattcaccaccctggtaaggcctttgggcccaatgagcagaagcggttcggtgcgttccgcgttccccatggtgagaagcatgccgggaaggccgctgatatggtcggcatgataatgggtgaaacatataatatccaccggcttcggactccagcccttctccttcatcgcaatctgcgttccctcgccgcagtcaatcatgatactttttccattataacgggccatgagggatgtgagccaccgatacggcagcggcatcattcctccggttcccagtaaacatacatccagcattctgtcgtattactccattccgctacagaagctccctggcctcctttacttcggcaggcacgcggaactctgcaagcattttatcaaaacattgttcgcacaggtcaaaatggtatacctgtccgtccttgctgctgaaatacccgaaggcatgctttacttcgaagcatccttccttcagtattccattttccaccttcatttctttgccgcatcggttgcatatcaccgatataagctccgtattgttattatcaagataaattcgcatggccactcctatccgcgcttttacgctttctgttttaatcattataacgtaaatttttgtcgaaaaacagcggtaattattccatgcgctgcctatctcttccacataataagagcgttttcagccggatcccggtaaaaatttttccggatcccttctacagtaaagcccagggattcatatagccggaccgcagggagattgctttccctgacctccagcgtaaaattttccacgccgcaaagcttcgcccggcgcatcagttccagcagcagtctgcgggcacagccttttcttctgctgccctcctccaccgccacattggtaatatccccgtcttcaaaggactgccagattccacagcaggcgatcagcctgccctcctccatgcaggacagatagagtgcatttttatcggaaagcgcctgctccagggcctgctccgaccaggcgtccgaaccgaagcaggcggcttccagcgcggccgcctgagataaatcctccggaagcattgtacggatttccattacgtttcaccgctttcacgattcttaagcttctgctgcctggaataggtcccttttctcatcatggcatccccggccttatcgcctgctgttttctgcgcctcgctgcgttcccgttctgcctgggaggggcgcaggtattccggaacatgggcggctgcggattccattttgcccaaacgggcgtaggtctgtgcaaggacggctaccgccgaggcacgctgcctgttgcagagcgcaggggcaaaggtatagggacggtgcatgagagccgccagtttttcccggaatacgggaacgccgtctcctaaaaataccacgcagtcttctccgggaagcgcattcagcttctccgctatagtttcaatgggaaccacgcactggggttccagaatatccagtttaaaattcacctctaatgaggaggtttcctgcgacgtctcctccggaaggaaacggtaaataccggtatagacctggcttcttctcgcatccatgagggggcatacgatatgatccgttccgtatacattcatggcaagcgcatccaccgtaggaacgctgataatcggtttatccaatgcaagccccagccccttggctgtggcagagccgatccgtagtcccgtaaaggaaccaggtcccgcggatactgcgatggcatcaatacaggacagatccagctcaatcatttttttcacttcatccagcatggggagcagggtctgagagtgtgttttcttataatttgttgtgtattcggctatgaggctgtcatcctccgtcaccgccacactggctaccagccctgagctgtctatggctaatattttcattcctgcgcttctcctatccttgtcagggtaattttgcggtaatcaaagcccctgcttaaatctttttctatccgcacctgtgtatatgcagggggaagaatttcctcaatgaggttggcccattctatcaggcacagcccttctccgtaaatgcagtcctcaaagcccacctcctccatttcctccggatcgccaatccggtatacgtcaaaatggtaaaaaggcatacggccttcctcatagatctgcacgatggtaaacgtagggctgctgaccggctccgttatgccaagccctgctgcaactccctgggtaaaaacggttttgcccacgcccagatctccgatcagggtataaacctggccgggcttcgcttcctgtcctattttttctcccaacgcatacgtttcctctgcgctgaagctttcaatcacttctgtttgctgattcatattccaattctcctgttatcccggcacgggctgctataccaccggccggcttcacatccggatgtttacctttttcggaggcatgtgtgtggaaatcatctccactgctttggaaagattatccttcagatctctgcggggaaaaatgctggcattgattcttgtagtataaagtacgatactgcgggctgtggacactgctttcaccatatcctcccatttctggaattccgttgcttctccctgggatacctccaccccttcttccgtcattttgtaatggaggggctgcttgaaggcgggattggtaagagcctgctgcttggccttaagaaacaggctgcccggctggtacagcagtatcaccaggccggcaataagatagattatatggccggtcatgccgaatgccaccagcatcagtgcgcccaccgtggttcccaccactccggcaaagctggtgtaggtatggtgaagcatgtagtcatacagtactcctgaatctattttgacatcaaattccacttccatttaagtatatactcctgatatttattttgttgtatatctcagacccgaaaaagcacctacatcgtaggtgcttttgtctacttaacattatattatactgataatccgctataacgcaagttattttctaccgggagctgtcctggctttcaggattattcatggcgcagcgcttcaatcgggctgagctttgcagcctttcttgcaggatagataccgaagaaaatacctacgcctgccgagaacagggatgcaatcagcacggtgcctaccttaactcttgcagcaaagccaatcacgccgcctatcagtatggcgcctgtaattcccagtataatgccgataatccctcccataagggtaataatggcggattcggacaagaactgcagcaggatggatccggtcctggctcccagggatttacggataccgatttccctggtacgttccgttacggaaaccagcatgatattcattacgccgataccgccgaccagcagggaaatcgctgccacaataactacaaagatagagatattgcccagaacggagttgatttgggaaatctgatcctgcatgttctgcacctggatcaacccttttcctctcacattatgccttccttccatgaggttgatcgtgctctgcgccacctgcatggattccgccggcgagtcacagataacataaaagtccgtaaaatcaccgaaatataatccataggaagcgctcagtatgctgagcggcagctcaatgttaatcatgtctccgtacatactgaacatggctgaagcgctgtccttacgtatgcctacgattctcagatcctgtgtggttccgtacagggtcacttcaatagtaaggccgataacatccgtagtgccgaacagcttcttggccgcctgctccggcaccacgcataccttattgccggagtagtaatcgttggcggtaaagtaacggcccgcaattatcggttcactctgatagaactccatgctctctgttccgccggaggcatatgcggtaaactcgccttttttaccgattacgctcccgtaaagggtatacaccggcgtaacgcctttgacgcccgccaccttttcctgtattgcttcaaaatcatctgcggagaaataaacctcatcttcactgtgttcattattaacataaataccaatcagccctccggccatggcattcagttcgtcgttaacctgtccctttactccgtcaccaatggaaataatcatgataacagatgtaataccgataataataccgagcatcgtcagaatggaccggcctttattgcttttgatattcatcagggcaatttttatatattcccatgcctgtgccactattgcatcctccttatatagaccgctgtgagcaggcccggattactcgtttccggaatccgccgcgccgtccgtctgtgtctgtgttccagcggtctccgtctcctggcctaccgcttcggaggagccttcttctgatgcgttttcagtggatgcttccgacgctgtttccacggctgcgccggtctcgggagccgctgcgtcagtcattgccgcacccgccatgccgcttcccataggaaccgccataaccttcatgccctctgtcaccatacctgtcacatcatataatatctgatcgccttccttcaggccttcctttacctcaaccatgctgtcagaggaaattcctgtggtgattcttctcatggttaccacgccgttttccacaacgtagcagaactcaccctgcttatccgcatttacgatttcaacaggtactgtaagaacattttccgcagatgcggtatggataacaagcttggcctccacgcccaggaaaatatcctcgtccgggttcttgatatgtacctctgctccaactacaggcgttccctgggaattggcagcggccactttattgattttggaaacctcgccttcatattcttttcctgcaatggtaacatccaccttctggccgatttcgattttgggcaggtcatatttggtgacttcgatgcccacctttacctgcttgttgctttctatggtaaaaagctcggttccttcagctacggtagccccttccagaaggccgccgcccttggttgcatccttggatgtggatacggtggcaatcttggttacgatgccggggaattccgcaacaacacccgcctgagccttctccagctctgccgccgcttcacttgcggtaatctgtgcgctctgtacggtatctgcctgctgctgcttggaataaggatcggcaattcccgcttcggaggaggattcctttccttcccgcttgctgatctcttctttcatatcctccagcttcttctgctccgcgtcaataatacgctgggtctccctcaggtcctcggacatgctcagatcgctgagctggttgcttgtttcccgaatgctgttattcaggttctggatgatttcctgaattccttttctggcatctgaatcactctgctcagccagcttattattctgggtctccagctcctggttcagcttgcccagccagtcctgaagcttttctctttcacgctgggtttcatcctccagctggtatttcagtccctgtacgtactgctcctgctgctcggcaaggatcttcagttcgtccaggccgatggttgcttcattatactctgattcattcttgttgctctgatactgggagcttctgtagctgttcgccgttgcggaagcatccagcgccgcttttgcttttctgttttccagttcggtggtgtcgaaggataccagctgctgtccttctgccacctcatcgcccagggcgatcttcatctcagagatagtggcgcctaccggcgcatagtatgtcttgctctgctcactgctcaccgtaccgctggtggacatggtctcttcaatgcttcccatcgtcacttcaatggtattcacctgcatgggcgtattcttggcaattacgctggtcactacggaataacccacaatgactaccacgagaaccagcgcaataatccagcctattttcttctttttcttcttctgtgtgccgccggccataatggcctctctcttctgctgcgctttcttttccttagcttcggctttttctcttttcttcttttcctttgccgtctcctggacctccgtcaggttttcggcgcccttgttttctaactcactcatcttgtatcctccattcagtcccatcgggtagttgcctttattcataaaaacagagccggcctgcggcttgtcctgcgccgcttcccacactgcttcttataactgtctgaaagcctgctttagcagttattcttcataaatttccgtctcctggacataatccgcttcaatctggccgtccttaatcctgataatacgttctgcctgagctgcaatgtcattatcatgggtaataatgattaccgttctgccttccttatgtaaatccttcagaatccccataatttccttcgtagatccggaatccaggttaccggtaggctcatccgcaaggattaccggaggtgcctgggcaatcgctcttgcgatggcaactctctgctgctgcccgccggacatctcagagggcttatggctcattcttttctcaaggcccactctcgtgagggcattcctggaaagctctgtccgctcccttttccccacgccgcggtaaatcaggggcagctccacattttccagggccgtcagattctggatcaggttaaagccctgaaaaataaagccgatttccctgttcctgatatccgaaagatcatcgtcgctcattcttgaaacatcctggtcatgcagaagatatgttccgcttgtaggtacatccaggcaccccagcatgttcatcagcgtagactttccggaaccggaatggccgataattgctacaaattcattctcattaatggttacattgacatgatcaagcgcccgcacctcattttcacccgggttatataccttacacatgtcctttacttcaaccagcgcactcatagattctctccctttgttttccataagcccatgacctgcaatgcaggcggcctcacctggaaaaccgcatgatatatcacctgtattatgtaattaatacagtaatactgattcagctctttgtcaactggtatttttcttccagctgatgaagccaattccattttggccttatccggcagccggacccgaggttcggcattccttataaataagtccttcttggaattactccgactatcatactatagttgccttctaaaaatctatgcagttcttttaaatatttcttaattttttctaaataacgtaagtttctgtataatttttatgtattatgacataataaaagaaaaaacgaaggagaaaaacatgagtcttttaaacgatgacgggatacctttggggctgggaatggccctggcgcagaatatggatgccatgcggactttttcttccatgagcgaaagtgcaagacaggatgtgattgaccgttcaaggcatgtgcagtcaaaacaggaaatggaaaatctggtgaatggactttccggcgaatcgggtttttcggaaaaactgagctgaggattcattttttagttccaaaagcttcacagtttcttcaaaattccatcacgattcctacacacttaaatgttatcttatacctatacaaagccaataagaaaattttagatagatttctttttcataacttgccggcatccggaaaagatgccggccctccctcaaaaaaacccggcaggccgcaatggcctgccttttttattattttttgctgtgcaggatggggctgagttttttataaatcagcatggttactatggaaacaatgccgcctttcatcaggttcatgggcgctacggcaaataatgcaagcgtagtcacgctgttgatggagggattgatggcgtggcccaggccgacaatggaatctaacggcattccgtacagctctgcaaatttggggagcaggtacaccgcgttgaaggcagttccgaaaactgtcattacaagtgttcccacaacacaaccgattatggcatttttcttgttcttgcggaacaggtatatgatagaggcaggaagcaggaagctgcagccgatgataaaattggccagatctcctacaaatgcggtggaggttcctttaaacagaagcttcaggataattttgcagaactcaatcatgaccgccgccaccgggccaaaggcaaatgcgccgatcagggcaggaagctcgctgaaatccattttatagaattccggggcaaaggggatggggaaatccagcatgtgcaggatgaccgctatcgccgaaaatacgcctatcatggctatttttctggtggtgagggtacgttccctgtttccgtttttctttcgttcccatttttccaccacgtaggcgatgattaccatggctgccacaagccccagaaactccaggacaaaaataaggttttccgcgaaggacgctgctaaatcattcattatgtatactctccttttctttctccggccagccggagttattgcgtaagacaaggaaaattcttctgatgcttcatgaaaggaaggtatcaaaaaagcccggagaaatgattctccgggcagatatccaatccctggaaaacacctgtcgcctccgtaaaccaaacggcgaaaaaacaggtattccatgcatgattttcttctttcatccagactttactgtcggttccggattcgtaccggatcagccgcatgacgcgggtcgcggacttgtctgcacctgtcgtggaacaactgcagcgtcaccgccggtagggaattacacccaaccctgaagaactttacctttattaaattgttactctattatcatagcaggattttattaaatgtcaaggcgcggattgtccgtttgtccgcatacatttctccgcatacgtttctccacacgctcatttgcccgcgcaccggggcggacaggaaggcgctgcagcagtacagcgttctgagccattatgtttttttatttttaaggggttgcaaattccagtcaatccgctagactgaaattatatttaacccggccggttaaaccaaagcagtcaggaggtgttccatgaacgaacagtttttccatttgcccgaagaaaaacagcaggcaataatcaatgcgtccctggaggtgtttgccacgcatgaatataagcgggcatccacggatgatatcgccgcaaaggcagggatatccaaagggctgcttttctactatttccataataaaaagagtttatatctttatatttatgattatacaaaacaaattgtgacggctcaggtcgttgatgcccattttaaggagatcactgacttttttgagctgctggcctattctgcgcagaaaaaggccgccatcatgtcgcgcaatccctatctgatggattttgtaatgcgctgcttttatccggaaaaggaagaggtatcaaatgagttaaacagcacaaaccaggattatatagataattctatcttcctgtattttaaaaatgtggatttctcaagatttcggcaggatgccgacccgcaacagatactgcggatgcttttgtggatggcggacggctacatcagcgagaaacgaaggcagggtaaaccgtttgtgctggatgaaattatgcatgattttaaggaatggagcgatatgttccgtcggctttcttacagggaggagtatttatgaatgccatagatatcagtcatatcactaaggattacggcagtcacaagggaatatttgatgtttcattatcggtaaaaaaaggtgaggtttacggctttctcggtcctaacggcgcgggaaaaaccacaacaatacggcatctgcttggttttctgcgtccggaaaagggctcctgccgcattctgggcatggactgttttcatgaggccgccgtcatccagaaatcactgggctacctggccggggagatcgcttttcctgaggattgcaccggcgacgggcttctcaggcttctggcggaaatgaaagggattaaggacaaaagccgaatgcgggaattgatggagctgcttgagctggatccttccggccgcgtgagaaaaatgtcaaagggcatgaagcagaagctgggcatcgtaaatgcttttatggggaatcccgaaatcgtaattctggatgagcccaccagcggcctggatccattaatgcagaatcgctttatcgaactgattctggaagaaaaaaagaagggaaccactgtttttatgtcctcccatctgtttgaagaggtggaacgcacctgtgaaaggacggcgataatcaggcagggggaaattgccgccattgaggatatggaggggcttaagaaaaaacggacaagagactacattatcacgctggacagcaaagaggcggcggatgctcttgtcctgcccggattttcaatcacgcgaagggaaggctgtcaggttaccgttgccgtgaagggggatatccccaggctactgtctctgttgtcggaatgttctgtcagggatctgcagatccacacacagacgctggaagaaatttttcttcattattatggaggtgaaaaggcatgatttcattaccgcttttgaaaagaaatctggcacagacctggaaaattctgctgattatattggctgcgatgaccatgtataccacagttattatttatatgtacgaccctgagcttgcccacatgcttaacgattaccagcaggcgctgccggggatgatgaccgcagtgggaatgacaggaattgcggggaatctgactgaattcgtacatatttatctgtatggatttatcatgctggtttttcctgttatttttctgattattcttgggaataagcttcttgcacattatgtggacaccggttctatggctgtacttctgtccactcccaactcacggatacggattttagtgacgcagctgttaaccctgctgctggaaacggcgcttttgattgtcctgatcacggccatcggaattgtcagctgcgaaagcctgtttcccggcgaactggatatccctgtctatctgaagctgaatgcagcgcttcttctgctgcacctgatgctgggaggaatcggttttctgccggcatgtattttcaatgattcaaagtggtatttcttcgtcggcgccgggctgctgattctgtttttcctgtttcagatgcttggtaatatgggcggggatttggagtttttccggtatcttacaccatttacgctgttccctggagaaaaaattgtgtcaggtcaggacggcgccgccgggagctgtgtgattatggcggtgattggggcggcgctgtatgggagcggggttgtgtgctttgggcggaaggatctgccgttgtaaatgtttgatatggaaagggaaaaggtatggaaaacgcgccgcttcagcagtaacagctgaattttggccttgatttccataccttttttgctatttttaatatgtaatactaatgcatgaaaccatacttttgaaagcttaagactttgtcagtttcctcaaatccattgtactgtagctctttggcaaatatagcccaatccggctcgtctacagtttcatcctcctcatcatggcggactgaccggctgtccagcatgcggatgtttccgtaatcctgcggcgttatccgccttatttttaattccatatataattaatttcctttatcaagctgtcgcacgcgttcgtcaaccagggttctttcagggatggaaacggctgcgccttcccgggatacggtaatggaagaagcgcaggcagcaagacgcagcgcctcctgcatggtcttcccttccactatagccgcgataaaatatccggtgaaggtatctcctgctgctgtagtatccacagcattcactggaaaacagggctgatatacacattcctccgcgcttttgtaaacagcgcccttccggcccaatgtaaggattaccttcatttgaggatatttctccagaagaatctccgtgatacggtcgggatcggaggcacctgtaatgtcatttccttccgtttcattcagcatcagccaggtgacgccggaaagatccgtctttttcaggctctcattcatcggcgaagggttaaacagaatccgcattcccatagcggcgcctttttcaagaagatagggaaggttgctgatttcgttttgcaaaaccagaatatctccttcaccgaaatcttccagcacctggttgatgaattctctgccgttctcataattgctgccgttaaaaaggatgatgcagttttccccttcttcggaaacctgaatcagcgcatgtcctgtaatgcttccgttctcacgcagataccgggtatccacgccgctttccttaagcagctccgccaggaagcggccgtccgggcctatggtcccggcatgataaatcggaaccccggcacgtgctgccgcaatagactggttcagccccttgccaccgggaaagcattgatattcttttgaaaaaatcgtctcgcccggccttacaaaatgcttcactttatataccttatcaatattcagtgaaccgaaatttaaaatcttcatgttttgctcccatctgtcttatatcctgtcatgtgccgtaaacgtccaccaggactgtatatttactgtgcaagctttctgaataaatcctcaaacagattgtccctgttaatatggtaaacatatctgataaaatgccttccggggtcaaagctgtaatgatgatcatactgcggaatcgggctgggcaccagcctgtcacgcatgaaatcaccgtccagcagccaggccaccgcggtgacatcccagatcacccttgtccagcagctgtttttgcttccggctgcgccttccttttccgtgtagtctgtcagataatcgcacagcttgtttttgccgcggagaaaagtctccagttcgccggggccggtggtgaaagaggataccacgcccatgcagggaagctgtaccaaagctgcgccgcagccgaataccactctcgccgcggccacatcctggaaaagattgaattccttattatccggccattcatgggcattgccgccaagccagatgagaactatgcggtctttgatttccggcttcatgagcagggctgaggccacattggtaatggctccgatggcaatgacgtacaggggcttttccggcgtatagccaagcgccagcgcggccagatgcgctgcggcatcggatgcaacgggtgtctcttcgtccggaaggtattgggcggagccgcggtatacgtgttccttcagttcctgcttttccatcaagtccaggatatggtggatttcctgatagcttttttccataccgtcttctggtccgctggatttctcattatggaagggcgctgcataaacagccttcagatgcagcttttcctccgatttgatgagataggccagggcatactggtcgtcgatttcattataggtgtccgtgtccagaaccacatcgaccggtccttcgggccggttcaggcgctgtaagtaagaaatatcctgattcattttcccctcccttggcacagacgccgcctgcgctgatcaaataattactgtgaacagaagctttactgcatttggtgcggcagcatggataatcggactgttaccggcatccgcagttttccggtccactatacttttgtatcatgttctttcattatatcggttcctccgggagttgtcatgatggagtgttttacaaaactttttctgaaaagtatacagaatgccgggacgaacagcgcaatgccgggcggcggattttcgctttttcagattctttttgccaggagcggctgcatagattataataataggcataacaggtttctatagggagggtttgctgatttatgataaccaaaaataagaacattttatcaggcggcgctgttgcttttcttctatgtcttcttttttgcatggcggttccgctgcccttatgtgcggcggggacgttagcgtccggaggggaaaacgggagtgggaatcaaggggaagatgctgcagcgcagtctgctgtgcctcaggccgaccgggtgacttatcaggaggggttcttttatgaatccttaagtgatgcggtgaaggaaaagattaccggaatttcttatggggaggggtgtattgttccctatgaggagcttaaatatctgcaggtgctgtatatggactttgagggacagccgcaggtgggagaaatcatatgtaaccaggcgattgcccaggatttggttgaaattttctatgagctttatcaggcgtcatatccgatagaacggatacggctgatcgatgaatacggcggtgacgatacgctttccatggaggcaaataatacctcctgctttaattaccgggtggtggacggcacctccagcctttccaggcatgcctacgggctggccgttgatataaatccgctgtataatccctatgtaacctatcccaacggcaaaagaagggtctctccggccgccagtgaaatatatgcggacaggagcctggattttccggccaaaatagataaaaatgatctgtgttaccagctgtttacggagcatggcttcacctggggcggaaactggaaaaccatgaaggattaccagcatttccagaaggccctgccgcagaagtaggggaagcgggaaacggttcagctattttaattgttatataagtggaggtgtttatggacatcaggctgcattatctggaaaaggggaaggggacgccgcttctgctccttcatggaaacggtgaaaacgcagattattttgagcatcagatttctttcttttctgaaaaatatcatgtttatgccctggacaccagggggcatgggaagtcgcccaggggagaagcgcctttcacgctggaacagtttgccctggatttggaagcctttatggatgaaaaaggactggagcaggctgatatcctgggcttctccgatggggccaacatcgccctgctcttcgcgctgcggcatccccggcgggttggcaggctgattttgaacggggccaatttgtttcccaaaggcgtgaaaaattccgttcagcttcccattgttatggggtatctgatggtttccctgattgcgttgttttctaaaaaggcggtgcccaataaggaaatgctggggttgatggtgacgcagccgcatattgatccggaggagcttctctctttacagatgccggttctcgtgattgccggaacaagggatatgatccggctgagccatacacagctgatagcaagatccatacccggaagcaagctggtcatcctggagggggatcattttattgcctccaggaagtgggaggccttcaataaaagcgtggatgcttttttgctggaaacggaaaacagaatccagccgcagaattaaaactgtccgtattatgtccgtagcatgaaaaaaatgctgcagtcccggtatccttggctgcagcattttttatatgcctttatttgtttttattatttttctgagtttcctgatcaagacgcatggtgagggaaatccttttcttggcaagatccacgtcaagaaccttcacatccacaatatcgcctacgctcactgcttccagaggatgcttgataaagcggtcggtaatctgggagatatgcacaaggccgtcctggtggacgccgatatccacaaaaacaccgaagtcaatcacatttcgcacggttcccttgagaatcatgccgggcttcagatccttcatgtccagcacgtcgctgcgcaggatgggggcgggcatgtcttctctggggtctctggccggtttttccagttccttaaggatgtcggtaagggtgatttcaccgattcccagctcttccgccattttcttcttgtcacggacacggcgttccaggcttgcggaggctgttcccgcagaggcggcggctccagtatcggttctgcctgcgggagcggaagctgcttttttgccggccggctcttcctgaagcaccgcgccgcccatggccgcagccagggcttttcccatggcggtattggtgttgcggatgacgatatttttctggttctgcggcttcggcttctggccgcggccctgaggggcggcgggctgctggcggagagcggctttcgcggattttgcctccgcctgcagctttttcacatcctccatggtcagatccagcctgtctaaaagcttcatggtcgcttcataggattccggatggacgctggtggcatccagcgggttatcaccgtcctgaatgcgcatgaaaccggcgcactgttcaaacgccttaggacccagcttggctaccttaagcagctgctttctgttggtaaagcggccgtttgtctcacggtattccacaatatttttggctattgtcttggagatgccggaaatgtattccagcagggaggcggaggcggtgttcagatccacgcccacacggtttacgcagtcttccactacgccgctgagggcttctcccagctttttctggttcatatcatgctggtactgtccgacgccgatggatttggggtcgatttttaccagctccgcaaggggatcctggaggcgtcttgcaatggaagcggcgcttctttgtcccacatcaaagttggggaattcctcggtggccagcttgcttgcggaataaacggacgcgccggcttcgttgactataatgtactggaccggggtgtccagctctttgatcaggtctacgattacctgctcggactcacgggaggccgttccattccctacggaaatcagggatacattgtattttttaatcagtcttttcagctccgccttggcttccgtcaccttgttctgaggggcggtggggtaaatcaccttcgtgtcaagcacctttccggtagcgtccaccaccgccagcttgcagccggtacggaaggcggggtcccagcccagcaccaccttgccggcgatgggaggctgcatgaggagctgttccaggttctttccgaaaacggaaatggcgccgtcctctgctttttccgtaaggtcgctgcggatttccctttcgatggcaggagcgatcaagcggttatagctgtctgcaatcacttcccggagaacagggctggtgacagggttctctttcgtaattacctttttttccagatagcggagaatccgctcttccggggcttcgatttttacggtgaggaatttttctttctctccgcggttgagggcgaggatgcggtggcctgcggcctttttcagcggttcctcgtaagcgtaatacatttcataaacgctggcggctttttcatccttggccgtgctggtgatttttccctcctcaaaggtgatgctgcggatatagattcggtagtcggcttcgtcggaaactgcctccgcgataatgtcttttgcaccctgcagagcgtccgcggcgctttccacacccttttcctcactgatgtatctggctgcttcttcctccagggggcggtcggtttcctgggcgagaatgaactgtgccaggccgtccaggcccttttccttggccacgctggcccttgtcttgcgtttggggcggtaagggcgataaagatcctccaccactaccagagtttcggccgccaggatcctggccttaagctcttcgtccagcttgccctgttcttcaatgctggcaagaacctgttccttcttttcctccagattgcgcaggtaattcagccgttcgtagagatcacggagctgttcgtcgttgagggagcctgtaacctccttgcggtaacgggaaatgaaggggatggtgttgccttcgtcaataagcttgactgcggcttccacctgccagcgctctaccttgagttcttctgtcagtttgcctgtaatatccatggttatttttctgttttcccctggcgcctgtgggaggccgggggttttcctttctttgaactaccgtaactgaatagctttttcacgcccttacagttacaaactacttttactgcgttgcagtacctgttttttattatagtggaaatgtccccccgatttcaagggggaatggaaacttcccctccatgtcctgctttgccgcgtcctggctgtgttcctgcagactgcgtcatcggggcggcgggcagggggtttgagggtatggggcagaatgaggaaatggggattatgtgtggggatttcatagttttttcatttgtgctggtgggggaaacgtgctacaatagcatccgtagggtttgtaggttaaatagaaacagcttatgttatatggtatgagttgataaaggagaattttatggatagctataataatgggccggtgccgccttatcagaataatgggtcggggtatcctccgtattatacgccgcctacgcggcatccggggagcagctttgctacagcttccatggtgctggggattattgccgttatcagcgctttttttgcaacggtgtatccaccgattatctgcggggggctttcgattattttgagcctgctttccaaggggaatgataaggctatgctcccgaatgccaaagtcgggctgctgacggggattctggggatggttgtgaatgtggttgtggttggaagttttttcgtgatgctgtttacgaatccttcttataagcaggagtttcacgatcagctgaatcagtattcggagtatttttatggcgagagctttgatgatatgtgggagcagattcaggaggatgcagggtatcattagagcggttgcaggcgctgctttatccaggcggattttttacggggatgaagggtacgtgggccggcggtgttttgcagtaactgtgcgggaacgggattgttatcagttatggttcaggcagctgggctattatgggtatttttgatttttgaatgcagaaggagatttacatatggacagacatgcatcttcagcggagctgaaggctaaggcaaaggggcagatgctggggaaatacgggaccttggttccggcgtttcttgtggtggaagtgattatgacgatgattaatttcatggcgacgttttcactgaatacgaggactatgacggggctgacggtgcagttcgtgattgagtgtctgctgcagctgctgatgggtattttccttgcggggcagacttacatgtatctgaatgtgtgctgcggggggaatatcaagatcagcgatgttttttatggatttgggaaccatccggataaggcgattctaatccagctttttcagctgctgctttgtctggttttctttgtaccgctttttatctgtatggctattttcagttttgttgatgtttcggtgtccgtaatgatactggtgttttctattacatttgtgatcgggctggtgggtggaactattatcagcctgcagtattctcagagtttttatgtttgcctggattttccggagttttcggcaattgagtgcctgcggtacagccggaagattatgaagggaagcaaggggcggcgtttttatctggctgtaagctttatcccgctttatctgctggggctgcttacctgcgggatcggtctgctgtttgtgattccatatgcgaatactgcatccgctaatttttatctggagctgatgagctatcggaacaggcataatcagtaaaacacgcttttgggggcgtaattgttttaagggggatttcctatgacttcctgcagcaggaaccttcctgtcacttacagagagtacaaattcgccgcggattttccgattcttttgatggaggttaaatccacgacgccgcagatagattttattcattttcataactgcattgaaatcgcattctgtcagagcggaaccatgacctggaatctggagaatcaggtatcttccctttcaccggggaatatctgttttcttcctcccttctttacgcatggttctttttttccgtcgcaggagggtgaggtttcgtgcagttatcttttttttaatccggaacagcttctggctcctttttatcccaacgggcttcccagtgaatttacctggtatcagtatacggatttttccaagcttctgtcaggggagcggttttgtgaggaggtggagcttatccggatgataatcggggaattgacagacagagtgggacattacaggacggctgtccggggaatggtggagacgcttctggtcttgctgtaccgcaaacatcagggctgttccgtttttggcgggggcggttcgtctctgccgcagctgtttcccgccatatcctatctggattcggaatatgcggccgagctggatacggcgcatctggcctatctgtgcgggctgtcttcgcggcagtttatgcagcgtttccaggagagctttcagcagacgccgctgcagtatctgagaaccgtacggattcagaaggcgtgcaggatgctgacaagcagcgaaacgggcattctggatatcgctctgcagacgggctttcactcgctgtccagctttaaccggtattttcataaaattgtagggagctctccccaggcctttcggaatgacagacgcgccattgtgaaaaaggatcccaggtatgctccctatcgtgccacgtaggctgtgcggcgttcccagtttctgagctcgtcagttacccagcagaagcgctgcgtttcaaaatcaggcaggaaggaacaatccgcgcccagcatcaggccgtccatgcttccaaaggccttccggtaggtttccaggatatttacggtttcctgccggatttctttttctgtgccggcatagagcagctttccccggcggttgtcaaagccgcccatgcagttgcgcatgccgaacattttcctgccctccgtcagagggaggttttccacgtaaatagcccagttaaccgtgttggcagggtaatccttccatagctccagctggtttttgatctgattccagccgcagaaatggaggatattataaggagagctttcctccatggccgtaatcaccagctgttcggagggggctatgaagtctgagaattcttccggggtgaacaggccgctctctgctccctgcaacgccagaaaaatgcccatacagccggcgtcttcgatcagtttcctgctcaggtatgccagatcctcccccagaaaaaggagtacgtcacggatcgcctggggatcctccctgaaaaatgtaaaaaatctttcctctcctatcctgcgcagaagggtaaagggggaaaagacattgcaccaggtgtctgtatcccctgccagccgatcgttgatccgtgcggcgcgatccaggtattttctgatgtaaggattgttctgaaatcccgggcggtaagccttcagctcggaaagctccgtcagattaagatcgacaggggctgtgaggccatcgtgcatgattttcaggaaatccggttccgtgcggcggcaaaagcgtatatgtgcttccacgcaggcctcacccgacagctcccaggggttaaggtgctggaaaaagctgaccgggacatgggcgtggggctttccttccagcatctgccggaggttttcttttttttggtacgtcatccttttaccgctcctatcattacgcctttttcaaaatatttctgcaggaacgggtaaataatgagaatcgggatggtggagacaatgatggtgcagtatttcacaagctcgctgctgaaggtgtcttccacggcggcaatcagggaatccgcattctgcgcctggttctctataaggatttcacgcagtatcatctggaggggatagattttcctgtcccttgtgaacatggctgccggaaaccatgagttccactggcctacgccatagtagagaatcataaccgccaccaccggcttggaaaggggcatgatgattctggaaaatacggtaaaatcgttggcgccatcaatgatagcggcctcctccaggctttccgggatggattcgaagaaggttttcatgatgatcatgttataggcgctgaccgcatagggtatgctggatacccagatggtgttgtaaagccctgtattcctgataacgaaaaacaaggggatcagtccgccgctgaagaacatggtaaaaatcatgagcttcatcactcccctgcggatcaggaagcatttccgggataccacataagctgcaaagctggtcagcacaacctggagcagggttccgatgatcaggtaaaacaacgtgattttaaagccgttgaaaagactcttgtttgccagggttttctggtagcctgccagcgtggcttcgccgaggggcttccacagcaatcccgtatgggatttgaggagaatgggatcactgatggaggccaccaccacatagtacatgggatacagggtgattcctattaaaaacagcataatcaggacatttatgacctggaagggttttacttttttcttcataccgcacctctctttgtcaacatgacgcttaccacagactggtttcattcaccttccggctcaccgtgttggccagaatcagcagaacgaaattaatgatggagttaaaaaatcccacggccgcggcgaagctgtattcaaaattcatcagacctatccggtaaacgtaggtggaaataacatccgccttctcatagaccatggggttgtacagaagcaggattttatcccagcccagggtcatcatattgccgatacgcatgatcagcagtatcactatcgtaggggaaatgcccggcagggttacgtgaataatttttttaaaacggttggcgccgtctatttcagcggcttcgtacaggctctggtcaatgccagtcagcgcggcaaaataaatgatggaatcccagccgaattcctgccagatgcacatcagtacatacagcggctggaaataggcggaatggctgaacatgttagaggcctcctggcctgtaaccgcgcagaaaacgctggtgatcacgccgtttgttttacagaaatccagcatgagaccgcagattaccactgcggagataaaatgcggcatgtaggtgatggtctgggttattttcctgagtctggtccctgtcagctcattcagcagaatggcaaatatgatcgggaacgggaaaccgaaaagcagcagaaggaggttgatggaaaccgtatttctcatggtacggaaaaagtaaggatctcccaggaaggccttgaaatgcttcagtcccacaaaatcacttccgaaaatccctttggtgggaacgtaatcgaacagggatataatcatcccgtacatgggatagtaatgatacacaaggaaatatgcgagaaccggtaaaatcatgatgtacagaagcggatgtgacctcatgtttctccacagtatcttaaaaaaaggctcttttttcgcgctgaccgcacctcttttcatcttagctcctctctgcgtgcgccggcacgcatatcaatctgttattatggaataaagcggcagctgcccggctgacaaagcagctgcaaaaggccggctctacttccgccagcctttttctgcatttctccgttctttttactgattatttatggaaataaccgtccggtacctttacagtcgcactgtatgacgattactcacgggcttcatatcttgcataagcagccgcattgatttcttcggcgcgttcgctgcccagttccttcagctgtgccacaaagccgtcccagccgctttccagatcctcttccccgaagatgaaacggtaaaccatttcgtcggaatagttggcaagctttgttttaatctgtgtcagctccttggattcctccgtggtcagtgtcaggtagccgggaagcgtatgcttgtcgtcattttttgtgccccaggcatcccatgactggtggcattcctccagtgcatactgggctgcctccatggtttcatcgtatttaatctggaagggggagcacatgtaaagggatcttaccgtgtcatagtcaagtccgtccgggttttccgtaacaaattcggtaaattccctggttccgtcggcaccttccgtataagttttttcatcgccttcattagttccccaggctgtgagaagcataacctcggggctcatcaggtagtccacgaatttaaccgcttcctccgggtgcttgctggtggccgcaacctgccaggaataggagttgatggagcctgtgattttggacatatgggtggtgtcatccgcatttactctgggcagcacacaggaggtcagtttgaactccggatctactgctgcgcctgcggttacggactgttttacattataggtatgggcaaagcacatgccggctgtgccgttctggaacagcttgagggaatcatcaatggtacgggatacgaagtccgtatcaatcaggccttcctcagcccactgtttcaggaccttcagaaattccttatagccgtcctgtgttctgctgtaatgtacatttccgtcatcgtccaggtcaaactccttgatggaaacatcaaatgcagaggcaatggggttgttggcagaaaactgtgcctggttaaattcacagagggcaaggggaatctgcacgccgttctccttgaaggtacgcagcacgttggtgtagtcatccagtgtgacaggcgcttccaggttgtatttatccagccagtcctgccttacgatcaggccgttgaaaatcttattgttgtcggtgggaggaagccaggtggttccgaatttaacaatgtttccttcgtcacctctgattttcttctgtacatccgggtctccgctttcctcgcagaggttcttgaaattcaccgcatactgctccaccagatccgttacgttataaaggactccgtctgaaatcgcgccctccacaccgccggggtaggttgtctggaacaggttggtgtacatgaggtccggcaaatctcctgatgccagcagctgctggaaataggagccgtcatcccctacgggcgcatggatgaattcaaatttcagtccggtatcctcagaaattttctggacaacaggattttctcccaaatccgaatagtaggctctggctgctgtctggaaatcacagaaaattgtcagggtaacatctccgtccgcgattttggtgcttccggttcccgctgcctccgttcctgcctctgtaccgtcctcagtcccctgggagacggatgcttcctgtgccgtcgttccgctttgcgccgtttctgatgccgcattgccgcagcctcccagcatagatgccgcggcaaggactgccgccatcaacgctgcgcttgtttttttccactttctcataactctctcttcctttcttgtactatgtcacaacacgtggccgtctcgcagccgctccatattattgcgtctgaatccacgtgatactgcctgtttaaggtctgatatccagtccgtctatccgcagaatgccacagatgtatatctccagcgctttttgtattcttgcaagcgctatgctttcatcgggctggtggtaatcgccgtgtccgggagcaaacagtccttcaggggccggcgggagtttcatgcccgtgccaaaggcaaaggcattgggcagctttcttgcataggttcctccgctcatgacaaacggtccgtcttcattctccagaagctcctgacagattccggttagcgcctttgccaccgcatgctccgggtcaaagtaattggcttttgaaaggcgggtgacctttaaatcaaagccgcgcagtgacgcagcctccttcgcacgctcttcaaaggggaagccggtgcaggtaacgggatattgggaggaaaaaccgatcaccagatgtccatcctgtatgcacagctgcgtcgctaccatattaatggggccggaaagcccgtcctcgcagaaaacatcaagcgcattgcccgtatggtccttgtttatatccaaaatcaaagaaaaaagtttcctgttttcttcgcttatcaattcctgtccgcacaatacatccgctaaaatagtcagggcatttttaccggccccgggattggatgaatgagaagaaacaccccgggcagttatatgaataccgtccccttccctccgcactgtcagggcagcacccaggttaccgcattttttccaaagtgcgtcgctgtatttcagggtaatcccggccttatccggtatcatgtacagcttgttatcgcagacggcagccagcagctcctctccgcattcctgccgtgaaatcaactctccgttgaaggagccacgttctccgcagcataccggaaatccgctgtcaggcacaagggacagggtagggcagtcgtaatgcttcacataatagtccagatcgtacatgccctgctcctcacaggttccaaggtacagctccagatcgtgagaaagcctgatattatgttctttcatatatttcagcacataaagtcccataatagctgagcttttgttatcctggcagccccgggcaataaaatagccgtcttttactgcgggcacatagggctcgtagttccagtccctgccttcctcaactacatccaaatgcgcccagatacctatactgtctttattttcccggctgttatagcaaatcttacctacatagttgtcatagttatgaaccgcaaaaccattttcttctccgatgtgaagcatttcctccagaacctcacggcagcctttgccataaggcggattctctgccgcatccacctcggccacactcctgatacagcagatgcgtgtcagatcctttacgatatccggcatgtggttttcaatccacctgcgtatctcctgtgtatccatttcttttccattcagaataccgtccatttttttcatctcctgtctttgcaaaaacagttcatccgtcaatcatttccgttcgacatatccgattgcatccctttactttttctgcttttttcgatataatttttcgtaaagtgtatgtatgaatcctcgaatattttatattatttatgcactttattgcttttttcttcatttattgatttactgttattataattatacaaagccgccgcttcctatcattaaggagttaaaaactatgcagaaacaatcattccaacgatttcccattagatacaggccctatgatttcccctcccggttcccggtgcttgcttttctcggggataactggaccatttccgtgaattcaccggagtatcttcattttcataatgggctggaaatcggacactgcatcagcggaaacggacagctgtttctggccggccaggctcctgtaccctatgaagcggaagccttcagcatcctttttccgcaggtaccccatttggcggtacgcggcttgcaggaaagccgctgggaatatatttatattgatccaaagcattttctggaatccgcatcggactgtggttcggatacctggcagattttttatatgcttcaggaggttcccgtgattgtgacggcagcctcctttcctttgctttaccactatctatcccgtattttccgggaattccaggaaaaagaaccgctttatcagcaggctgtccatgggctgttgttttcccttttttcagaaatcaaccgcattaccatgtcggctgcagactcggtcatgtcggaatccggggacagctattcttatatccgcagcgcgctcagttatctgtatgcacattataatgagccattttccgtcagcggccttgcggagcactgctgcatcagcgaaagccatctgcgcaggctgtttaaaaatatggtggggatcagtcctttggagtatctgcagcattaccgcatccagcaggcctgccacctgattcatttaaaccagatgcctgtcagcgtcattgcgcagcaggtggggtacagcagcctttccagctttaaccggcagttccagcagtatatgcatatgtcgccttcagagtggaaaaaggagcatctggctgatgcgacgccccatgaggtgcgctcttatgatgaccaccgtacccgccacattttccagatatagatacaagcccggaaggcacggcatctgcttacgtatgcggcaggggcgggctggagggagggggaagggggttttgtgcaagtcctggttagaccgggcattacgctgagccttgggcgaaaaattatgtcaggagagccttccataatttttaagtctcagcttcatggtctaaaaaggattgtacaaaacccccttccccctccctccagcccgcccctgccgcatcgtaagcaaatgccgtgccttccgggctttgaggttatgtagggcggaacggtcaaaagatatagtaattgtatataggaggggtgtggtatgatgaggtatggtatttggggtgaaattgtgatatttgtatttggtgcctttattaggggaatttgaagggtgtattcagtagagcagcgtatttgccacgttttatgtatgaaagtgatttaagaggatttaaattcaatcgtgaaagtgatcggggatggaatttcgcagtaactgtgaaggtattgaatttgtattaataaacatcaaagagcgtctgcttcaaattgaggcaggcgctctttataggtttaaaaattataaaattgttcaatggtgtttccaggttattcttcgccatcggctttgccggtgcttatccatttaagataagcgttgatgaaggagtctaatgctccgtccataacggcgtctacgtttccggtttcgtggttggttctgtggtctttgaccatggtgtagggctggaaaacgtaggagcggatttgattgccccagccgatttctttgacttcaccgcggattccggaaagcttctgggcgttttcttcctgtctgagcatatacagcttggctttcagcatctgcatggccttatctttgttctggaactgggagcgctcgttctggcactgtaccacaattccggtaggaagatgggtgatacggatggctgaggaggtcttgttaatatgctggccgcctgcgccgctgcttcggtaggtatcgattctgaggtcttcctcattgatttcgatatccaggtcttcttcaatatcgggcatgacatccagggatacaaaggaagtctggcgtttgccctgtgcgttgaatggggagatccgcaccaggcggtgcactcctttttctgatttcagatagccgtatgcgttttctccgtttacctggaaggtaacggatttaatgccggcttcgtcgccgtccaggaaatccaggacttccacagtaaagccttttcgttccgcccatctggtatacattctgtaaagcatgctgcaccagtcgcagctttcggtaccgcctgcgcctgcattaagcttcagtatggcgccgttcttatcatactcgccggtaagaagcgtgctgatgcgcagcgtttccagttcttccgtgaaggaatccagctcagaacggatttcctccgccatagactcatcgttttcctcatttcccatttcaatgagcgtctcgatatcgtcatactgggtgaacagattctcaatctgctccacggtatccttcaggttcttaagttctttcattttcttattggaatattcaggattatcccaaaatcccggagcctccatctcgcgctccaattcttcgattcgcttagacttttcagctaagttaaagtgaatccctcacttccgctaatggagttttataagcctgtaattcctgtttcatctgatccaacaaaaccactaacgatcaccacctttacgatcttctacgagccgggcgccggagaggaaacagaaagcttccgggaaacagacgcccgggccgccctatgcccggacgcctgcttcccgaaagctttctgtttcctctccggcatgcggcgacagccgcaaagcgaaagggccgaaggcccttgagcctccccggcggattaccgggttaccattccttaaaccgcggaggtcaagtcacccttccgggtcctccatccctccactaattccttatccccaatccatctcttacttattctttacttattcttcccacagcagttcttatacttcttcccgctgccgcaaggacagggatcattcggatataccttcttttcgctccgtttcatcggagccttcgggccggaatcatccttattggtgccggtcaccttggcaacctgctccctttccaccttctgctccactctcacgtggaagagcagccggatggtatcctccctgatactgtcggtcatgctgtcaaacatctcataaccgctcatcttatactcaaccagaggatccctctgggcataagcctgcaaaccaattccctgacgcagctgatccatatcatcgatatgagccatccacttattatcaatcaccttcagcagaatcacccgctccagctcacggatagcttccggctccgggaattccgcctccttgctctcatacagcttcacagcctcttccttcagctgctgcttcagactgtttctctttggcttgttcacccgctcctttgtaacaggaaccagcggtataatcggcagaagcagggaattgagctccttgaaattccaatcctccacatccgcgtcttcaccgattaccatgtccacggtattatccacaatatccgtaatcattttgtaaataacatcgcgcatgctttccccgtccaggacacggcgtctttcagcgtaaataatctcacgctgctcgttcataacctgatcgtactccagcaggttctttctgataccgaagttgttgctctctattttcttctgcgccgtttcaatggcgttgctgagcatcttgtgctcgatttcctgattttccggaacacccatggtgttgaacatattgatcagacgctcggatccgaacagcctcatcaaatcatcttccagcgaaatgtagaacttggattcacctggatctccctgtcgtccggaacgtccgcgcagctgattgtcgatacgcctggactcatgccgctccgtaccgataatctttaatccgcccgctgccttggcattatcatccagcttaatatccgtaccacggccggccatattggtggcaatggtaacggcgccgtggataccggcatccgcaacgatttccgcttccagctcatggaacttggcattcagcaccttatgcgggattccctttctcttcagaaggccgctcagctcttcggaagcctcaatggtaatcgtaccaaccaggacaggctgccccttggcatgggactcctccactgcctccacaatcgcatgcagcttttcttttctggtcttgtaaaccgcatcctgatggtcaattctctgaatcggcctgttggtgggaatctcgataacgtccatgccgtaaatatcgcggaattccttttcctcagtaagtgcggtacctgtcatacctgcttttttctcaaatttattaaagaagttctggaaggtaatggtcgccagcgtcttgctttctctcttgacctgtacgtgctccttcgcttcaatcgcctgatggagtccgtcggaataacggcggcccggcatgatacgtccggtaaattcatcgacgatcagaacctggtcgtcctttaccacatagtccttatcgcggaacatgaggttatttgcacgcagggccaggatgatattatgctggatttccagattctccggatccgcgaggttctcaatctggaaaaatctttccactttagcaacaccctgctccgtcaggttgaccactttatccttttcattgacaacgaagtctcccgattcctcctgttccacgcccatgatggcgtccagcttggacagatcctccatgtccgcgccgcgctccatctgttttgccaggatatcgcaggcctcgtacagcttggtggatttcccgctctggccggaaatgatcagaggggttctggcctcatcgatcaaaatggagtcaacctcatcgatgatggcataatgcaggtcacgcagcaccagctgttccttataaatgaccatgttgtctctcaggtagtcaaagcccaattcattattggtcacataggtaatatccttggcataagcggcgcgtctttcctccggcttcatgctgtttaataccacgcctacctccaggcccaggaattcatgaaccgcgcccatccaggcggagtccctggcagccaggtaatcgttgaccgtaaccacatggacaccctttccttccagggcattcagatacgccggaagcgtggaaaccatggtcttaccttcaccggttttcatttcagcgatacgtccctgatgcaggatgataccgcccatcagctgtacgcggaagggttccatgttcaggactcttctggcagcctcacgcaccgtggcataagcctccggaagcaggtcatccagtgtttccccttcggagagacgcttcctgaattccttcgtcttatccttcagctgttcatcggaaagctccatcatcgcgggccttaaagactcaatcttgtccacaatggggataacgcgcttcaattccctgtcgctgtgcgtgccgaaaactttttgaattacattcattttgtatttgctccaatcgttttgtccgctaaaataacccgtctcggcccatttctctgccctttacggcaaaagccggacatgcactaccccttataatagcagaaaagcggcatttgttcaacttttatctgctttcggggaaaaccttagccgtatatttataggtcagcgtaaaagttccggttttccggccttttccagacgccggaattacatcatttatgttatatgacttttttcaaaaaaaatccatagataaactatgaaaagtctgtaaattttcgcagtcaaccgttcaaaaggactgataccccttatcagaatatcagtccctggtattacatcatttattcagttttaccggatattgaacttaataatactgtgtctcctgtattttgtgcccattgtttcagcagatgccgcattttctgcaaaatatcactcatagctttatctttatacaaattattcatttcatatggatccagacataaatcgtataattcttcgatctgtgagtcgttatatatatacttataacgctgcgtgattaccgcccgtcccaaatgcttttccaaatgtccatgtgtttcgcatacaaaataatccctgaagttaacatcattgccttcccttattttcaacagagaattcccatccacatcctttttaaaagcgctgccggcagcgtccagcattgtaggcgctacatccagattgctcacaagcgcattgcttacaagcccctccggcattttcccagggaaacgaaccgccatgggaacacgcagcatttcttctggcatataagaacgtttatcaaaatgccccccatgacaggccaatgcatcaccatgatccgttgtccaaattacaattgtattttcttcaaagccatgctcttttatagcgtcaagaatctttcccgctgcggcatccatcattgtaatttgtgcataagctctggcaatcacctcctgccagacactccatggaagagggttaggaaaaattatcttatcatcactggaaatacctctgttattttctgactgataaacttcaggtttattattgtgatacacatcttcccggaaactgggatactcagggatatcagatggagaatacatatccgcatattccttacaaggaaaatatggctgatgcgggccccaaaaatcaattctgagatgaaatggtttaccattctccttttcctttaattctctcagtttttcacatgccatatccgccagaaaaaaagcctcatgcgtctctggaggcgtcagcataattcctgaggcatgttcgttgcaccagctgcgatcctgctggtattcttttccctcctccagttcttcatatggaacaaagcttgagaaattatgttcaatcaaaattctgggttccggaagttttttccttcggagatactctttatattctggtttgttatatggattattatagcttggataattaaagccctcacaatgatgttccaatgcagttcccggcccggcatgccactttccaaagtagtaattatcataaccttcctcatataatgtatccagataaacctccgtatcaaagggatgatctgcatcattaataagttctccatgattatggggatataatcctgtaagcatactccttcttgccggaccgcataaagggcatactgaataagcccgttcaaaccgcactccctcagaagcaaatttatcaaaaacagggcgttttattctgactccctgactgccatgcccataatttacctgatgatcatttagtatatatattatattgggctttttgtttttcactatattttcctcctatcccgctgtttaatccttattcggacaattaagtgttcctttaccaaaaggccttcctcaccggaagcggatcacaagtctgagccattctgtcacataacttttccagcataagtatttttacatcttctgcatctttttcataatagagattatgatgttctcccggatctgcggccaaatcatataattcccccgttatctgctgtttttcttcgggatcgtgcactctgcagagtttatatctgccgtcataaaccattgttacaaaggccagcggtgaacggtgattaatattgctgttataatattcgctgtaaacattgttccgatgtttattcagcattctttctcctgtaagcaatggccaaagactcattccctgcatacctgctgccttttgaataccggcagcttcacagacagtctccgaaatgtcagtcaactcaaccagcgcattactggttctccctccctttattttaccaggacaggtaaaaatcaaaggaacatgtacactgctttcatagaaatacggtcctttaagatacatgccatgatcgcccaggctttctccatgatctgacgtaaatattatcagggtatcattcagctgttcatttatttccagccagtcaagcagtcttcccacttgatgatcaatcaaatctatcattgcaaaatatgctgcacgtatatagcgatggtctgccggactcatttcttcaaaagggaaaagaccttccgtatcatatgcgccaaaatgatccgttttctgaaataccggttttgtttcccattctttttccacataatccggaagttccaattcttccagcctgctaagatatctctccaggtattccttcggtggatcaaagggatggtgaggatcaaaataatttaatgaaaagaaccagggaagatgatatcttttagcactctccataaattgtatcgcctgattggtgcaccaggttgtctgatgcagatcttcaggcatccctgtctgaatatatttacattctgttctgtcaggtgttatataatccgtccccttttcagccaaccacatactatactcattcatcggccagttcgttccggaaaaggccgccggatggtgtgaccatctgaaaaaatcatagccgtcatcgattcttggttccatgattttacatgcagaatcatgacaggcggaaatatgaagttttccggccaagccacagtaatatccattcatatgtaaaagttttggcaaaagtatctcatccttttgcatatcctgtccgttctgacgcacaccacaggtccttggataccgccctgtcagaaaactagctctgcttggaccgcagaccgggcattgtgcatatgcccggtcaaatttcacgcccatttgagccaacctgtctatattaggtgtttttacccagggattcccataacatcccaatgtatcaaatctttgctgatctgtacaaatccataatacattcataatttcctttccctaattggcgtgactgcagccttacgattccatcattatattgtagtatttctgataaagctctgcccagcgatccgcttgcagatccttcatttttttaatataagcatcccagctttcgtccgtcactccattcgtaataaactgtgcgagctggctgtcaacatatttaaacaaatctgtcttaatattcagtgcctctctgttttcatcctcttcatataccaattccggaaggcctggtgccgcaaccttcatatagctttcattcaaagcaccctgccgttccaatgcggtttccgctgtaatttctttctcagcccaaaaatccccaaagcaccaataaggaattccatatccccatgttgcatataaagtggaattttccattgtcctgggttccccggaaggaatattggcaagttcggtccacttcccgttctccagataatcccaggagtaacccttaggcccgaaacggtttgttaaagcattttctgaattgtccatccaccagtcaataaaagcaagtgtttccgcaggatgctcattagctgaagtgataaaaaactggttgcccacataaccgggtatcagcccgtttcttctccacacctgatttccgtccggaccttccggaagattcatgacacgatattcattcatgctctcatctccgtcattcaagtccagataccagaatactacagacgccgccacaccttctgttttggctttggccttcaactgagtgctgctttgggtaaagttttcaggatcaagcagcccttcttcataccattcatggaaatattccagagctttcctggtttcctccatagccggcgcaaattgcagctgtgttgttccttcctctgaatgcatataactcctcgtatcccaggaaaccccaaacagaccaaacaaatacgtataaatactgggagcattttgtaatgcctcaaagctcaggccatattcgttcttaccgtcaccattcagatccctgctcgttgcctgtcgaaggtattcaccaaattcatccagggtagccggcatatccatgccaagcttatcaagataactttgattgatatataaaatcttgtccacacggatattctggttttcatcgattgcaggcagtgcatatatatgtccgtcgggataagtagacaacgccctgaattcatcgtaatcattcatccattttttaatatttattgttgcgttttcaatataatcatctaatggtacaatcagaccttcttttgcatacttgtaaatgacagatggatcataggtaaatgacggtccgaaagcatcaggaagatctcctgaggccagcgtaagcttgtatttttctgtatacgcctcggatgacacctcttcccattcaatatgcacatttgttttttcttcatattccttgatcatgtctaaatcgccaagcgattttgcatgggaagctgtaataggaatcataattttaattgtaatcggttcttttgatataggaaactcacctggtacaaaaccgatttttcctgcttcctgagcttcttcactttgttgctgtactgcattttcttccgcactgtttccgccgcaacccgccagcattgcaacaatcatagctcctgctaaaacacagcttaataatctttttttcatgttcttcctcctgtaaaataatgttttcttactttgtttttatatacagccttatatactcattcctttaccgcccccagcataaccccctttgtaaaatatttttgaataaacggataaatacagagcactggtatggatgccactacaataaccccatattttatcaactccgcatatctttctcttcgcaacagttccagcatcatagattcatcaaaaacctgcatggtggaggaattttgaatcagtatttctcttagtaccatctgaagcggcctaagagcttcttttgaaatataaatcaatgcattaaaatactgattccagtgcgctaccccgtaatatacaacaagaacccctattaaagcttttgataacggcagaacaatcgaaataaaaaatctgaatttaccgcagccgtcaatttccgccgcgtccattaaatcttttgaaattgttccttcaaaaaatgaacgggcaattatcatattatatatattcagtgctcccaaaagtacgagtacaaagggcgtatcatataatcccaaaccttttattaataaaaaagtgggaattaaaccaccattaaaaaacatggtaaaaaggaaaaatcctgtaaagatttttcttcccggcagttttttgaaagaaagcggataggctgtaataagtgtaagacataaatccagcgttgttcctgctgccgtatatagaatcgtgttcctgtatcctgtaaaaatacgtgagtcttcaaataatttttggtacccttccagcgttacgcctattgggtacagcataaccttgccggcatttaccgcttccggagaactgatggaagcaatcagaacaaaataaagcggataaactgcaatcaaagatacaattcccagtattaaataacttataatgtcgaaagccaaatcactgccggagcgtttgacatgtacttttttccttcccatataaacctccttaaaataatgagcttttcgttattttctttgccgctttatttaccaacagcagtataatgaggtttatcacattattaaacagccccactgctgccgaatacccataatcaatatccagaagtcctttcttatatacataggtagataaaatttcggatactccgatattcaaatcattttgcatcagatacgctttttcaaagcccatactcattaccgcccctgcattcagagtaagtataattgcaatagtaggaatgatatgcggcatatctatatgaataatccgctgtaatttatttgctccgtccatccttgccgcctcataaagctcaggactgactccggaaagtgtggccaggtaaataattgaattccatcctgtagtctgccagacggcagaaagaacgaatatatgcctgaaatacttttcatctcccataaaaagctgacgttctccacccgccagttcaagaatattattaaaaactcctctgggagcaaacataatcatcatcatgcctacgagcactactacagataccagatacggcgcatatgtaacattctgaacaaactttccaaatttcttactttgacacgagtttatcagcaacgccagaaagataggaatcggaaatgtcaatacaagctgataaatactcagtattaaagtgttccataatataggcaggaaatccggtgaacggaaaactcttttaaaatgttccaagcctacccacggactccccaaaatccccttagaagcataaaaatctttaaatgctattgtcactccatacataggaatgtaattgaaaataaaaatgtagattattcctggaatgagcataaggtacagtaccctccatctcttccacagcagtttgttttttgtcactcccaccactccttatctttaattatttcttttgtccgggacttgattctttgaaaagttccctcaccggctaatccaactttaattcttttatcgctcgcagtaaatattgcataattcattcattgttcgcgcttcatttttgcgcattgtttttatttcacttatgcttcttttttcatttttgtgaatttattctaattttttccatataattccatataatttgttgactttgacaattacatttaatatactatacaataatagattatcaatatcaaatgcggggtgattccgagaaatgaatattccaaagactgctgtccgtaatttcattacatattttattgttttttcaatccctgtaataagcctggttttttttacacatactcagcttataaaaaaattccagacaacaacatataatctggaactttcctaccaaaacaataaactaaatgatttcgaacagaatattaataaattgatagatattgcttcacaaatcaaaatttcagaaacggaactgaacgaaaatattatgtcccgtattgatctgattgatcagcttcgttattgtaaggctctgaataatactcttgaagaaattattttatattttcctgacagcagtcttgtctatgctgcgcagagtacatatacccagaatacttttaaggctttatttggtccgtctctctcctccgcactttcaggtatatccgaagacgaatggaatgccaagggactgattccgctgttctcagacggaaaactttgctttatagccccttatcccatatattctctgtacccctatggatatctggttttcattgtccagcagggacggtttatgcccttttcccagcaggaatatgctctttactacgatgaaacctgtctgattaacaaaaccggccgcccccaatatgacctggattatgcaagatctaatggaacatctgtaacaacggctaatccttacagttatctgtcttcatctatgtccggcggtgattatagtcttgttacagtattaaatgatgaggaaacattttatgatttttatcatgccagacaactttttattcttacaagcattattgtctgcactttatccatgattctcctcagttatttcagttatcaaagctataaaccttaccgggatcttaagcatgcattacagcgtacaggactgattcatgagcgttcaaccaatgcaaaaccagaaatataccaggcgatacaaaccatggatcttttgaccaagcacaaccggcttcttgacgaacagttaatccaggaacagtatgtgtcaagaagccttcttctgaacagactcctgaacaatcagtatgataatattgagacaatcaataagagtctggaaaactaccgtgtaattttaaacagtacttatttcactgtatgtattttcaggcttaacaagaaaccatctccacaattttttcttgacaatatgctgtattatgctgcacatccaggtttttctgtctattgtacactggaatctgacctgcgcatttatgctgtcataggatccatcagtaatcaaaatacacagcttgactcactgtttcggaaaatgctgcaaattctgaatggagagggaatttcagcagagttatatgttggttctcctgtcatggaaaaagaccaaatccatatatcctatattgaagccttatccaaatataattatgatgatcttcctgataacaaaatccactattatcattctccggcctctattaacccagtattattctatccccagatggagttaaacagtctgcgcagtgcggtagccagtgaaaacaaagatagtgcgatagaaattctggaatgtatcagttcacagcttctttctgatacactcagttactcaatggcaaaaacagtttgttatgaagtcttccatatcgtctgtcagggattgagcacggaacaaccagaaagtttccagactatcaatcgttacctttcaaagctttcaaaaataaaaacttgcgaggatgctgctgcttttcttactttgatgaagaaatccctttctgataccgtctctgtatgcaaaagctcagaagaatgttctaatttaaaaatggaacgcattcaatcctatattatggaacattttacagagcccgacttttatcttggagccgttgcagaacatttcagtttatcacttaataatctcagtcagcagtttaaacggcatttgggcattagccctgccaaatatattacggtattgaaaatcgatcaggcaaaggagcttcttacaaaaaccaatatgactattaaggatatcgccgctcacataggttattctgactcctccatatttgtaaaaaattttaagacaataacctctttaaccccaaatcaatatagaaacagcatgcggcaatagagttttaataatccggtcttatttacttgactttttctgtatttctatgctattacaaatgaacgccactacatacacactggaaaccatcaattatttattgctttcaaaatctgttgttatgttaatttctttaatccccgcccctaaaagggcagacaggagccgccatgaaaatacgtcaggaaacacccgccgactacgcggaggtttatgagcttgtaaagatatcctttgccacctcgaccaatgaaggggaatgggattatctgaatgaagtccgcaaaaaggctgcctttattcctaaactttccctggttgcggaaaatgacgacggccggctggtggggcaaatcgttttgtataaaacggacattaccacaccggagggcgccgtgacgcagctgctgctttctcctatcagcgtgcatccggattatttccgcaggggcatcgccactgctatgatgaaggaagcctttcatatcgcgcaggagcttggctacacggctgtgtttctctgcggggatccgcaattttaccatcgctttggattcaggggatcttatgaattcgggatttaccatgtggcggacaagtcccgctgcggggaatggtgcatggcgctggagctgaaggaaggcgcgctgtccggaattaccgggacgattgatattgaataataatatttttttcaaaaactttgtaacgaaaccgtaactcctccgtctaaccagcaaaatcgataagaagggaggcgaagtcgtggaaatggatttcgagcagttatacaacacctattacatgcaggtatattcctttgtcctggcactgtcccggaaccgggacatttcagaggaaatcacgcagaaaacatttttcagggcaatcaccgccgggaagaaatatgccgggaattcctccgagctcacctggctgtgcgccattgccaagaacctgttcaccgacgagctgcggctgcagaagaaaacctgcgttgccgaaacagaggaaaaggcgtccggcatcagcgtggaaagcgccgtcatgaacgaggattccgcatttcagatacatcaggtgctgcataatctggaagaaccatataaggaagtatttcagctaagagtgttcggtgagctgtctttccagaaaatcggaaagctgttcggcaaaacggaaaactgggcaagagttacttaccaccgcgcacgtcttaaaattcaggaaaggatggaggagctatgaaatattcatgtgatgttattaaagacctgctgcctctttattatgataaggcctgcagcgaacagagtaagaaaattgtggaggaacacctggaggaatgcgcttcctgccggagtttaatgaaaaaactgcaggacaacacctatgaaaattgtctgcatgatgaaaaagaagatattataaaaaattataccaggagcattaagaagaaagccctgtttgcaggatttatcgttgttgccgtcacgcttcttacctgctttatcgccaaccttgccaccggaaatacgctggactggttttttatcgtgctgacctccctgctggttttggcctccatcactgccgtacccatgatggcggaaaaaaagaaggggctgtggaccttgggaagctttgccgtcagtttgttcctgctgcttttgacctgctgcctgtatagcgggggaaactggctgcttgtggccacaacggccgtattgttcgggctttccgtggtctttctgcccttcgtcatcggccaggcgccgttaaagggctttgcagaacggaataaagggctgcttgtcatggctgtggatacgattcttttttacctgctcattgtctcctgtggtttttacagcaaagctaccggctactggcggccggcgcttcttatctccactgtgggcgcgctgatcgcctgggcgctgtttgcagccatccgctatctgaaagccaatggcttcatccgggccggtatctgcgtcattgccgtgggcgtggtcactgctttcgccaatgatattatcagcctgattttagacggcacctatcagctgagcgtgttccaggccaatcttaccctttggtcgacgaatgctttaattaatgcgaacgtctgcctgattgttctgctttccagctttgtcattggcgggcttctgctgcttgcgggcttcctccgcaatgggaaatccgccagataagcctccggggatggggacagcggagaagtgtccatgtattttaaaacacttctccgccgtccccgtccctttttagttttttgcctcccggttcataagatacatataggcgtcctccagcgtaatctccggctgcacacatcctggtcccggtttttccccgctgatgattttcacccgcaggccgctttccgtatactgcttcgaagtaatatggcaggtctgttcccacatccgggcctcttcttcattctttaccgtgcccacccagatatgtcccttggccatctgcagcagctcactcatctctcccgtatacaggaattccccctttttcataacagccagccggctgcaggcagcggccagatcctctaccacatgggtggaaaaaagcaccgtcctgtttttagagaaatccaccagcaggttccggatacgtatccgctcctccggatcaagccccgtggtaggttcatccacaatcaggaactccggctcgtttaaaagcgcctgaaccaggcccacacggcgtttcattccgccggacagctgcctcatctttttcttctgatgctccgccaagcttgttttttccagatactcgtcaattctctccctgcattccttccggggcacgccggacagcccgcccaggtattccaggcattcccggacggtcaggttcgggtacaggttcagctcctggggcagatatccgatttttcgccggattttctcataattgccttcactgtaagccaaatcgtccatcagtaccgttccggaggagggcttcaatacagtagtcagcacccgcatcagcgtggtttttcccgccccgttttcccccagcagcccgaaaatcccctgggggatttccagattcacatgatttacggctgttacgccgttcttaaagctcaccgttacatccttcatttttatattcattcctgctcctatctgcgcgaaaaaaatacgcggctaatgttatactcaaatcaggcggcgggaaacgcttccttccgtccgggggcagtgtttaccctccgcattcttcaaaagcgctccccaggcgcatattaactccttcatcctcttttctttaaaatatggggcagccacaccagcagaaacaccgcaatcagaatccccgccgcctttccccaaagccaggaaaagtcctccgggccatccagttcccggaaggcataggcgaaaatattgaaccttcccaaaaccttgtcaccggacgtggagtacagcgtcagccacagcaggaaggagcctccaatcccggcccactggttttgaaacagattggacaaggtcatcgacaatacgccaaagaaaatcactgtggccgtgattgccggaagatagcttccgtaaaggcccgccgccgttttttccaacggaacagcgggtttctgccaatagtaaaagaaatatcccacgtaggaaagcgcgcataaataacagagctgcaccgccagcctgcgaagcaccgtcttcgtcttgttttttaccggatacagcgtaaatatctcccagcgccttccgctgcgttccattacccaggtttcagcgcagaaaacaagggacagcaaagccatattggaatccagcgtgccgccgatttcatccactctggccacgcctcggatcaggcagagaaccaccggaaagaacaatgagtaaaaaattttgtatgccggaaggacaattttgatttcctgtttcaataaacccgcctccttttccagatgctgatggaaagtatcagcagaagcaccgacgcgcagattaaaaacgtctggttgagcaacgccagcggaggctgctcggtttcaaaaaactttcccgggaaacgcaccataatcgccagcggcctgccgaaatagccatagttcccgtccggccccctgctgcccatattggaatagatcatatataaaaacaaaaccggaaccgcgggcagcggattcttaaataccagggcagctgccgtataaacgcaggcaatcataagcaggttgggaaggatatacacggccgccgcaacgaaaaataccggaaagctgaccgggaatccgttttgtatccccgcatattcacacattcccccaaacagaagggtcaggaagccccataacagaaccattgccaggaaaccgcccatggccttcccgcagatataagcggatgcgctcaccggctttgtgtgcagcagctcccaggtatcccttttcgtatcccggatgaaaaggaacgccagcagaagcatcgccgtaaatcccagaaaaaggccgcagaaatccgtgaattttctgcccaggtagtaggaataggtatactctgaaaagctcctgtccagatagtcattaatttcccccgcacttcccttatgaaactccgatatgtcatagtagtaacggatgccgtattttgtatagaaattatagtcctcagccagtcttatttccatttcctccaggctcatatcctccctgcgcatctttgccagaatttcgccggcctcttcctctgtcatgttaagctcctgcgccatatccctttttaccaattcgcaggcaagctccatacgcttcccttcgtccgtgggcacatacccgtccgtgatgtccgcatccccgatattctcctctgccagctcctcagccgcctctccctgctgataatagtgaatatgcagatagggactgagtatctgatacatttgaaaaacaataaagaaaagaccaatccagaaaaaagggtttttcaggtagtttttcagttctcttcggataatggctttcataatatcccgcctttctttttatgcctgcggcactgccccattagtaagcagccatgccgcagtttttctataaaaatatcctagcatccgattatcaacaaaaaaacaacagaaaaaaagaacagccgtaactgtatagttacgaaccgttctctatcgatcccttccctgtttacctgtgttcctgtttacgtatgttccggaaatccgtcctcagccgcgtaaaatacggccttaaccactgcgcctcctgtttcggcatttcccacggccagcctgcctccgtgcttttcgcagtataccctgctgatatacattcccagcccggaatgctccagatcatcctggggattggaatggaaataagccttcatggcctgctgcgtgctcaccgtaaagccgcttccgtcatccatgaccgtcagctccagctcctttcctgccatgcggatgtcaaccgccacctctgtccttgcatacctcagggcgttggatacgaggttttccgccacctccaggacaagctccgcatccaggtatagtttttcctccgtatttttgccgctgaccatataccgcttccccgccgtctccgccatgaagctcacgctttgttccaccagcctttgcagcgccgaaagctccatttccctggggcaaacctttctttgttcaacaccggacaaggtgcgcatgctttccacaaaatgcttcagccgctcaatctgcgtcattccctcctgaagcatgtccatcattttgtccttgtccagggcatcctccggaacatattcaagcagcatctcctgatatccctgcaatatggcgaggggcgtcctgatatcgtgggccacggcggaacgcagcgccttttcctcctctatcatgtgccacattttccgctcatttctttccagctccgcccgcatcctctcaaattccccgcacagcctgcccagctcatccccggaggtataaacaatcctgaaatccagttcgttttttgcaatccgccctgatgcctccgacagctcctgaaggggcgtcttcagcttattgcggtaaaataaaaacacggcagctattgttcccgccacggaaatgaccaggctgctgtaggtctccagaaaatcacaggcctccgaaataaaatgatccgcgtccgtcatttcccaggcaccgggccttgggatgctgtcctggaaggtaaaatcagcctgttgtgcataagccgacgcatccatatattttatccagacccgtttctgtatcctgaccgccgccagcatgacggccgccgaggccaggaagctcaaaatgaggctcaccgccatatagagtatgatagattttctgattgaaagatcttttatttttcccaccggtatcccatcccccagaccgtctcaatgaattccgccgttgtgtactccgccagttttttcctgattctcctgatcagctctgtaatgacccggctgtctccctgggcatcgtagccgcataccttttcatagatcctttccctgtcgaatacctggccgggattcatggaaaggaattctatgatttcatattccgttctggtgaaatccgcttttttgccgtcaatccgcacttccttcgccgtgtagtcgatcatcagcccttcccggaaccggtactccgattttgtcctgtgccgttcctcccgtttcagatgggaaatgattctggcttccagctcttttaagctgaagggctttaaaatgtagtcgtcgccgcccgaaagcagtccgttcacccggtcctgctcctccgccttcgccgtgaggaacaggatcgggcaggaaatcttatcccgtatctgcctgcaaagctccagcccgtccatgccgggcatattgatgtcaagcagtatcagatccggcgcagcctttatgctttccatggcctccatcccgccggatgcggtatttacttcataaccctttaattccaggaaattggaaagcatttttaacagcgccctgtcgtcgtctaccagcaaaattttatatttcataaccaccatcctgtcattcaacgccggccccggcatcccacatgccccggcagttttttacggttccgccctgtccacgcgcatggcccgcactcccagcaggacagacagcgctcctatcacgaagaacaaaagatagagccagccggaattcttcctatccggcagatgctttcctgaaaaacaccaggctgaggcttcttcccagcggcatttcctccagttcctccctggttaccgctttgagcttaaggattcccgcgccgtaaactatgattccggcgcagactgccgcaataacccccacagtattccccgcccacaggcgtgtcagactgtaaaccgcagccgttgaagcgcccatcgccgtcgcggcgcacaacggcagaagaaaagtccttctgacctcctgccggtagcccagctccctaccgattgcccgccagttcaggatgcagaccaccagggcaaacgtcacattgccgatgaccaggccatagacgccccagtccagccatttcagcataacataaacgaaaatcacatggatcagcagcgaaacagcggaatgtgtcacggatttcctcatcagatcgattccctgcagcaccgcattcgtcaccgtggaaagcgagaaaaacaccaccgcacagctccccagacgcagcagatccgacgagattttccgtgaatcgccgaaaagcagctgcataaccggagaagcaagcacccccatccccactgcgcagggtatggccagaagcatgttgaattttatggtgatgccgattttatgccttacctcctccgtatcctttcccagcctggacatgacgatgctgggaatcatggacgctcccagagacgtcgctatggctaccggaacgttggtaagcagacggtattttccgctgtaaattccaagcattgactgtctttgcgcttcatccaaaccctttgccgacatgagattgccgaacagggcattgtccacagtaccgcttagctggtacaccgtctggcttaggataataggaaggaccgtcaggaaaagaagcataaaaatgtgttttagcgaagcggtttcttcacttttttccccggcagctttggcggaatgcatccgcttctgcttcgtcacatgcttcgccgtcagcaccgccagcagcacaaaagccgccgcggcccccgcaaacgttcccagggtgcctcctgccgcgccataggaagcgggattttcttttcccgcaaaccgcctcataaagtcaaaggaagcccatatgctcacagcggcatgaaccaactgctccacgatctgggaaaccgacgtgggaaccatatttccatgcccctggaaatacccccgcagcactcccatcagtgaaaacaccagaatggtcggcgccatgacccgcagcggcaaggcgcttcccggactcttgaaaattacctccgctattttctccgcgcccgcaagcagaaccgcagtcatcagcccgccggcaacggcccccagaacgccgccgcataccagaaccctgcgggagttctcccgctctcccttatattcatagcccgccagcagctttgatatcgccagcggcaggctgtaggaagaaaggataaggccgatattataaatctcataagcagtattatagtagccaatgccttcgtcacccaggatgcgtgtcatggggattttataaatcaggccaataaaacgcactataataccggcggcggccaaaatggccccctgcaggagaaaatcgtccccttttctctttttttcctcagtatcattcatccttcgtaattctccgttttccaataacagattactttcactgcttaataacagtccgtttccgtcataactatccatattataccattttcttagatataccgcatttaagatttcgttaactatttcttaaagtattgccgcttcgcagctgtttagtaccctcacagttacttgcaaccactttggcagaagaaacgcatcagcgcagactggaacggcggaaaggatggcgcctgcgctgatgcgtttctccgtaacagttcgggcaggtttgcgcattcactgcgcaaaccgtgagaaaacgtggtggcagcaggcatccgcccctcgccgaaggcgacttataatgggcggatgcagtaacagttcggccgaaggctgaactgttacgtttctccttgcgggtgtggtgatccgccttgacctttagaaatagaagtgttataattttaacaatgggcattttttatacagtttccggggttcctgccgtttccggcgtatggaaggtaatggttccccatctgcccgcagcaacacagattccacaataccataaaacaatttcaaatgaggtgcgaacaaatgagtacaagttttgacggactgatttccaaagtaaaagaatgcggccagaagaccgtatccgttgccgttgcgcaggacagcgcagttctggaagcggtaagggcggccaaggaccgcggcattgccaacgccatcctggtaggcgatgaggaaaaaatcaaagcaaccgcagcagcgggcggcattgacatttccgatttcgaaattatcaacgaacccgatgaatggactgctgccctgaccgcagtaaagcttgcccatgacggcaaggtggatatgtacatgaagggccttctggaaaccaaaaccttcttaaagagtattcttgacaaagaggttggcctgagaaccggaaatccgctttcccatgtatgcgtattcgatatccccggcatcgaccagctgctgttcttcaccgacgtggcattcatgacctaccctacgctggaggacaaggtacatattattgaaaataccgtagaagtggctcatgcctgcggcgttcccaaccccaaggtagcccctctggccgctgttgaggtggttaacccgaaaatgcccgtaaccgtagaggccgccgagctgacaaagatgtgcgaggaaggaaagatcaccggctgtgttgttgacggaccgctttccctcgatctggccattgatccggaggctgcaaaacacaaaggggcaaccgaccgcaaaatccagggtgatgcggacattctgctgttccccgacatccatgcaggaaacctggtttacaaagcaattgtgcacatggttaatggcgtaaagaacggatgcatccttacaggaacccaggttcccgccatccttaccagccgttccgatacctttgaaacaaaggtaaactccatcgccctggctgccgtagttgcggaagagctgaataaaaaaagaggctgagcggactaaccgcttcataaaagaaaaggagaaaaccctatgtcttataagagcttaattatcaatcccggttccacctcaaccaaaatcggtgtttttgaggacgaaacccttctttttgaagaaaccttaagacaccccactgaagaaatctcaaagtacgccaccatcatcgaccagaaggatttccgtaaagaaattatcacggacctcctgaaggagaagaacttcgacatccattccctggatttcatcgtaggacgcggcggactgcttaagcccatcccgggcggcacctacaaggtgagcgacgatctgcttaacgatctgaaaatcggctatcagggacagcacgcttccaacctgggcggtatcctggcaagggaaatcggcgattccatcggcgttccttcctttatcgttgacccggttgttgtagatgagctggagcctgttgccagatattccggatgccccgagcttcccagaagaagtatcttccatgccctgaaccagaaggctgttgccagaagatacgccaaggaatccggtatcccctacgaacagctgaacctgatcgtggtgcatatgggcggcggctgctccgtaggcgcacacagaggcggcaaaattgttgacgtaaacaacatcctcgacggcgaaggcgcattctctcccgaacgcgcaggcaccgtacccgccggtgatctggtgaaattatgcttctccggcaaatatacggaaaaagaaatttacaagaagctggttggcggcggcggcttcaacggctatgtgggaaccaatgacgcccgcatcgtggaagacaaagcgctggaaggcgtaccggaatacgcagctgtactggatgcattccattatcagatggcaaaggatatcggcgccatggccaccgtccttaacggcaaggttgacaagatcatccttacaggcggcatcgcttattccaaggtaacctgtgaagatctgaaaaagcgcgtaggctggattgccgactttgtaatctatcccggcgaggatgagcttcttgccctggcgcagggcggacttcgtgtgatgaagggtgaagaggaagcaaaggcttattaattacggaaactggagctgacatgacgaaaaaagaactggcgattgccaatcatgataagaaatacaattgctgtcaggctgttgcctgttccttctgtaaggaaatcggcgtggacgaggaaaccctcttccgtgccggtgaagccttcgggctgggcatgggctgcatggacggcacctgcggcgccgtttcaggagccgtaatgctggcaggctttaagaacagcgatggctgcctggcaaatcccgggaccaaagcagacacctataagctttcccgcgaaatcctgaaacgctttgaagagaagaatggcactatcatatgccgtgaactgaagggcattgacacaggaaaggttatccgcacctgccccggctgcattgaagatgcagtggaaatcgcgcaggaggttctggaactgtagactttcaggaaccaggataatactgatttcctcctgcaatcgcagggaaatacagaaaacgagaagtcggaaggatatatcatcttccggcttctctttttattttgccatataaggaaaactgataaaaagcagcagttcttccgtaatttcatcacggcatagtttttatttcatcccggcatggtatttttcttcagccgctttcggccgctgcgcctgaaatcctcccggttccaccgaaacaatggcgacaggaagttaaccagcggcttccaggacagaaacgccacaagcacaacgcttaaaatcagcgccgcagcttcatcatgctccacaaatttaaaaaacttaatcttgctcaggaatttaatcacaaagccgtggagcagatacaccggcatggtgttcgccccgatataggaaagaaacggtattttcgccgccggcatactcaacaggaaaaataaaagccacatcagcgcagcgccgatgctcagcacacggaactgccagccgtaatttccttttttataagaaacggagccgtaaagccacgcggaattgatatcctccgcatgccggctgataaaccagacaagcagcccaatcaacaccagcagcccggccatcagaaaagccctgagcatggcctttccccgcgccccggtaaggacggacagccttctatgcttcctcagatgctccgaaaccgtttccttcacaccgttcttcagttctttataatatacgcccagcaggaaataagggaaaaactccacaatcctggaggccgacagataatatcccgccttatcatcaaagccgatgagcacactggcggccccggccgctatgagcatgacggccttcctgcccaggctgccgccctgcaccagcggaagcaccagattccacacgatgatggcgaacagataccacagcagccagtacggcgtggtatactgcatatccgcatccttctccagcacctgatttgcgaaaatcacataaagggtctggaaaaccagataaggatatatcatattcttcttgattttatccggattatatctggcaaacactccggatacgaaagcaaacagcggcatatggaaggaatagatgaccagataaaggatccggttccccgaatctttacccataaacagctccagcatatgtcctaatacaactgcaaaaatgagcaggcatttcaaattatccatctggtaattccgcgctctcccgattcctccggcagcgcaggagcttacctcattctgtctcatgtcaggcacctctcttaagccacgctaaactatgtcaaatgccccttcccccaaaaaccttttaacctcaccaactatattactttttcccggatttgtccatactaaaatttcttaataatacttaagactttgtgaaatttgcagctgtccgggtaacagaagagttaccgggctttatccttttgtgaattccaaaagcgctgccccggcccggaaatctccctgtcccctaaacaaggctgcctatccagatggttacgcggaaggcatcggcagccggtgtgatgtccatatggccgccgtagctttctactacgtcacggacggatcggaggccgtagccatggttttctttatcgggcttggtggtgagaagtccggctttggattccgccagttccccggtcctgctgttttccacctcgatgcagagcgattccccggtgtagcgggccttgagggaaatgcggcgggcttccctgtcggggaccttctgcgccgcttctatggcattgtccagaaggttggcgaaaatggtgcacaggcttacgtcatccatggcgagaaggttatccagctcgatgttggcgaagcagtctatatttttttccagcgccaggttatattttgcgttaattaccgcgttgaccaggctgttttcacagaatttgcggtttcgggccgctgcggtgatattcagctctttaaaataggcaagcgccttgtcgtattccttttcctccaggaaggagccgatcacaccaaggtggttgttcatgtcgtggcgaagcttgcggaccgccagctggtttttttccagctcctcatagtatgcctggcgcaccttcatgttttccatttccatatccctgcggatggtttcaccgatataggccgccagccagatacagcccaggcttgtcaccacacaggccaggcaggatggataggtgagccaggcatctttatggcttatcgtggaaatcagggtgatgctgcctgcaaatgccgcggcgcatacgatatccatgagcagccacatccggtccgtcatcatttttatggaatgggcggcctttttacggaaggcaaagtaaatccccatccatatcagatcccgcaaaagcatggaaaaagcgttcagcgcggcatcccaaaagggggtctgcggcgtcagccggtaaaaaacgattccggtggcatccagggtcacaaaattgacggatacaatgatgggatacaggaggagtaccaccgacagccgccgcacaacgcttccttcaaagcagatgagcagcaccatggcaaataaaacgagcatcccgaaaacgttaaacgggtcctccggaaaaaccaccgtacagcccacaatccagacccctgcaatggcggccgccttttgcaggagtccctgcttcagcttcaggaagcaaagaaggaagcggaaaataaaggatacatatatgattgataatacacagattatcagattttttgaaaccatcatttcagcataaacctcgcaaaagccgccgccgtttcctggctgcaggaacggctgaccggtattttctctccttcacaatacagtgccgcgctttccagcttcgtcacataattcaggttcaccagatatctgttgtggcagcggacaaaaaagtcaggcagctcttcttccacttcgcccaacttcccgtaaaaagagattctctccccttccgccgctgccgctatctttcttccctcgctgacaaaatacctgacctgtcccagcgcaagacgcagggtgccggacttctgctccaccgtaaaatatttctccgtactgatttccagttccttcagcgcatcccgcagaacctcttttatctttttttcctgatacggctttaatatgtagttcagcgccctgacctcatagccatggaatacaaaatcaggataggaggtcacaaatattattaccgcgggctgtccgtttttccggagcgccctggccgcctccatgccgttcatgccgcccatctcaatatccaggaaaataatatccgcattcctttccctgatgccccgaagaagcgcctccccgctttcatattcggtcaggccgaactccacgccgtcaagcgcaagctctttttctatcacatggcgcagatccaacctcagttttttttcgtcatcgcaaatcgcaatttccagcattccgttacagctccgtttcttcctttttccaattcaggcccgccgcggccgcgcttccgatttcaggcggcgcgccaaagccgtatccagtataacatattccttatttcccgtgaatcaccgaactttacaaaatatctcccaaacattaccctgcctcccgtgggaaacaggcgccttttcccctacaatagaagcataaacaccggacacagcccggaagaaagagaggaatcaaacatgctgcacgtaaatcatttatataaaagctatcacaccggctccgccacctatgaggtgctaaaggacgttaacctcactgttgaaaaaggcgagttcgtggctgtcatggggccctcgggaagcggcaaaaccacattgctcaactgtatctcctgttttatcccccatgattccggagaaatcctgctgaacggcacgccgctggggaatctggatgaagcacggctggcgcaggtaagaagcaaaaaactgggctttgtatttcaggatttctgcctgctggacggcctgacggtatttgaaaacatctgtattcccaaaatcattcttcattctccctataagcccatggaggcaaaggcccaaaacctgatggagctgtttgacatcaccgatatcgcggacaaatatcccgctgagatttcaggagggcagaagcagcgcaccgccgttgccagggcattgatgaaccatccggatctgatcctggcggatgagcctaccggcaaccttgacagccgttccggcgccgccgtcatcggcgcattccgggaagccaaagagaaactggacgccacaattttcatggtcacacatgacagcttctccgccagccactgtgaccgggttcttctgatgcgggacggccaggtgcagaaggaactgaaacgccagggcagccgccgggaattcatggatatactgcttgatgaactgaaacaactcaatgaaaggatgtaaatcatgacactgcataccattttccaacatctccgtaaaaataatcccggcgaatacaggctgtttcttggctgcaataccttcgccattctccttatttcctctttcctggcagttctcaccagcccattggtgcaaagtgtcctgccggagggcggggactcccgcaagcaggtttacatcatatttgcggcggcgctccttggctgttttctttttaccatttattcctcatctctgtttctgcgttataaaagccgggaaacaggaatcctgaccgccatggggcttccccgcaaaacctatatgcgctcactgtcacgggagcttctttccctccttgccctgtgcgccgtctgcggaactgccgccggacagcttctgtcctttatcgtctggctctgttttctcccgctggtaaaacagtccaccggcgccgccttctccatttcagcccggggcttgttatatactctgctcttcgtaattctcatcgccgtgtccctgtttatccaggccaacctgtttatgaagcgcagcaatgtgatcgaaattattcaggaacagcacagaagcgagccgctgaaaaaaacagtcacccccggatatctgctttccggctgcatacttcttgtatcgggactgtttcttgcgctctgtctttcgcccctttcactgcgtttattccatagaagcctgggaagcctgccctctgtttttttcctgcctgccttcctaggaatttaccggattctggtgtactccatttcctgccataaaaagggagcgcggccccagcactactataaccatatcatttcctacaacatgttgaaattcctgggcgcgcaaatggtgcgcagcatgtgtatcattaccctgctgctgttctgcggtctgttcggcgccttctatgtccccacgcttatgacaggcctgagtaacttcaatacacagaatccggaggatgtatccttcttttatccggcggattccggggagctgacaaaggaagaaatttaccatattgccggggattttggcgtaaccattacggcttatcatgaactgaccttcctgaatctaattggcagctctgtggacagagattacgatgatcagggttacctcattgaaacctacatggaaaaatccggatacatgcagtttctcagtgaaagcgcctacaatgcctataccggggaagctgtccgggttcagcccggcacctacctgctgcttacccatccggatgccgctgaaacaatctgggcacattttgacgacctggatcagattacggatttgaatggaaatgcccaccctgtttcctttgcgggaacgcttgtctgccaccagctggtagtgggccgaggttctgacacccaggcaagatacgttctcagtgattctgattacgccatgctgtcggaaggcgctgctgataaaaacaagacgaaacaggtactgtttcaaacggcggatgcggaaaattcctatgccttcgccagggagctttaccgtgccttttccgagcgtgcaagctctgaaatgcttgttttagggaattatgatccctatcagcatgagcaggcgcgcagccagggaaaagagtacggctatgacagaacggtcacactttatccggagcagcccgaaagggattttgactggaaatacgcaccttattttaaaatacttgaacagaaaatctcttttgtccgtcatgctgtgtttttccttctctttttatatgttgccataatctgcctggctgccgccgtcatcattgcctacaccagaggccttaccctgggacagtccgaaaggctggtgttccgggatctgagccagcttggcgcaaataccgcgtttctgcggggctgcctttcctcccagcttcgcaggctcttcctccttccttccgtgattggtattttgtcagcttacctttttgatttctttgttatgttcaccaatgacggacatattgcctccgcagaagctatggcgcttgccatcaatgggagcatctgcctgaccgctgcgctgctgctggctgccgcatatggctattccgtaaaaaaagcctgccgggccgcaggatgttaaatcccgcggcatccactcccgcagcgactgtattacagctttgcagcttatccgtttattataattttgtatctatccaggacggcacatgattttgattattccctggggcgaacctgctccagggatatgattttatcagcgaagtcctggtaaaatttttcttcatgggacaccagaatcacggttccctcatactgttccagcgcctccttcaacgcctcctttgccaaatcatccaggtggttggtaggctcgtcaaggatcagcaggttcgcgggctgaagcgtcagcctgcacagcttgaccttggcctgttccccgccgcttaaggtagaaaggctctgccccgcctttttgctgtctattccgcatccggccagatgtcttctggcctctttttccgtaagctgaggaaaccaggagcggattgcggcaagcggcgtctgttccggcgtatcccaggaaaattcctgttcatagtagccggtctgtacggcctccgatatactgaaattaccgtccagggtctgcagctgccccaccagcgtctttaaaagcgtggatttgccgatgccgttgaagcccgtaatcactaccttctgtcccctgtttaccgtaaaactgatcccggaaatcaccggataataatatcctgctgccagcccgttcacctgcaggaggatttcttcatgcacctccctgcccgaatggaagcggaataccggcttcacataggttttggcaggcggagccatacgctccagccgttccagctgctttcttctgcccttggcattccggctgttgacaccggcaatgtttttacggatgtattcctccgtcttttttatctgcttctgctgggcggtataccgccttatataatcctcccgcagatgttttttctgtttcaggaagtctgagtattttccgctgtatttccggatgctttgttcatcaatatcgcagatacaggtgctgatctgctccaggaaggcaaaatcatgggataccaccagaaacgccccggaaaactccgtcagatattcggacagccaccggatatgctccttgtccagaaagttcgtgggttcatccagcagcagtacatccggctcctccagcagaagcttggaaagaatcaccttggcccgctgtcccccgcttaaattccccagttgtttatccatgccaatggctgtcagccccagaccctccgcaatccgcatgatccggtattcaatggaataaaaatccgcggcttccagctgctgctggtatttttccgcttttttcagcgcgtcctcttctccggccgaatagcgttgataagcctgtaccatctccttctccttttcaaaaagcgccgaaaaggatgcctgcatatactccagcacggtctgctgcgcatccgccgcggcatgctgatccaagtagccacggctgattcccggctgccacctgatctgtccctcatccggtatggtatttccggtacagatattgataaaagtgcttttccccacgccgttggctcctacgattcccacatgctctcctttgaacagggagaattccgcatttttatataaacatttgtcaccatagctcagtgacagctcagtaatatcaagtaagctcataatctgtcattcctctctttttgtgcctgccgcagatatttccaatgctttcccggcgttttacgcccatcgcattctgcagtccatacaaatatttctatcaaaaaaaggccctgcattcctgcaaagcccttccgcattacatccgcttccatgcacagatatcctcaggcattcttctccggcattgttgccgcaggaaggcctgtggtgtgcacagatacggaaaggccgcagacaaaacattgtccgcggcctctcatatatcacctacaacagcgctccgtaaaaaaggagcggcacgggtatcttcggagaaaaccggtacacaaaccagacacacgccgccccatattccggggcataccgtgtgtatactgctgcatctgttccgtttcttccgatgaaccgttactgcctaatgattaacctctgtacaatgtttcatcggttccagttgtacagagttgattcgccttgtaatcttatcggtttctgctgtaagtgtcattggtaatctccttttcccgccgctgcaaaaatctgacagtataaaatccgttactgtatgcggcccgggatttttaacatcctatcacagcgctttccatctgtcaagcagtaacagttcggccttcggccgaaccgttactgcatccgcccatgaaaagtcgccttcggcgaggtgcggatgcctgccgccgccatgctttctcacggtctgcacagtaaatgcacagacctgcctcaactgttacgtcaagcgtcgttagcagctgttgcccgattatgatgtcggccgttccagtctccctccatatagccggcaagttcctggtattccctctggatattctgatacatatccataatcggctgacagcgcactcctgtttttcccatgatatcgtcaaaattatcagtcataacatccacaatgctgccgtcaatgaggccgtcctctttcatcttgccgatgattcccacaatacgctccctggaaaaggcctccttgtagcttcttgtccctgcaagcgcactgacgatatctgcgacagccacaattctttcctccaggctgagatccatggccgtcaggcccaggggatagccggagccgtccagcttttcgtggtgcctcatggcaattttccgtattttttcttccacatcagggcccaggatcaggccggtaagctccacatgggtgcgcataatccgcatggcctgagggctcagcttcccggggaattccaggatttccacgggtatgccgatttttcccagatcatgaagcagggagccgaaataaatatcactcagtgccctgcccttaagccccatcctctttgcaagctcatagctgatgctggtcgtggtcatggtgtgggtcacggtatgcctgcttctgaaatcaatggtataaatcaccatgtccagatattttcttatctcttcctttgtgaagggaaccttccagattttttcccataattcagcttcccaggcctccctttcggaggaaagctccaggaaatcctctgccagcacaatatccgctatttcaggagaatatctcactccccgtccggccagaaggcgtcttgcaaattcctgatagctgcagccttcttcctccaggcacacatccgcccggtccgctatatacataatctgggcaagcctcttattctccgggctgacgccgggcagctcctgcagcctgctccaggtggtatgatggaacaggacccccggagccacttcctgcaaaggcgtaaaatacttaatgaacagataaccataaatggagtgttcctgcatatttctggtttcaaattccagcatccggctgatttcttccgttttataagcgccgatatcatggtacagagccaggatgcagatatcccgcatttccttttccgtatagccgcccagcctggcaagtatcctggatacgatacaggctacccggaacccgtggtccaccagcctggcatccacataattacaggcgcggcggactattcccagcacgcccctgttgtcaatataattaccatattcaatcatattccgcattttcttttctggcaaaaatttcacggaaggattcctcatagggctcccgtgcaatgccatattccgttacgattcctgcaatcaggctgtgatccgtcacatcgaatgcaggattatatacctttacgccctccggcgccatgcgttcccgataccacatctgtgtgacttcctctgcagggcgttcttcaatatgaatatccgcgcctgtggccgtattcatatcaatggtagaggtaggtgcgcagatatagacaggcacgttataataattcgcagcaatcgccaccgaagaagtgcctattttattagcggtatcaccgttacgggccactctgtcacagcctacgaaaacagcgtccacccagccgtttttcattacggtggccgccatattatcacaaatcagggtcacatccacacctgaggaatgcagctcatagctggtcagcctggctccctgcagcagcggacgggtctcatccgcaaaaacacggaagtgatagcctctttcctctcccagataaataggcgctgtggcggttccgtatttgcttgtggccagctgtcccgcattgcagtgggtgaggatgccgtcgccgggcttcacaagggtaaggccgaattccccgatggttttgcatacccggatatcctctgccttgatggcatccgcttccgctttcagaagccgcttgatttcttccaccgattgatccccattgtctgtcacaattttttccatacgcttcagcgcccaggacagatttaccgcggtggggcgggacgaatccagatattccttctgttttctgaattcggcaagaaaagtgctgtaatccgccgtatctatctgcttggccaaaaggtaaatgccaaaagccgccgccacgccaatggccggggcgccgcgtaccttcagaagataaatggcatcccacatttcctgtgcagttttcagacggataatctccgtttttcccggcagctttgtctgatctatgatgacaagagcgtcatccttatcatccagctctaccgtttcgtactccatgatatttttattctcactcaactgtgttacctccttgtattgcggagcaaaatgccagccctctgacaagcagaggattttcctccgcctaatgcatgccgggcttgatgctccgtcatccttccgcttatcaggcaggatgccctgtcagctttttccgggaaatttgacttcagacagaaggccccgaagggtcatcccttttgcttccagtgtttcgttcaccgccgttgccgcaaatatcaggaaaaaaattcccacaataagaaaatccagttttttggatatcttcttttcccagaccttcagcttatcttccctggttttcgctttctttgccactgcatttcctcctttcaggattctccggacgctgtccgatacttcgtccgccgtacagtctcagccgacaataatatccgcaaattccgctgccgccgcttttgccagatctgccggatccagttcaatctgggaaccgatgcggcctccgcttacgattacggaaggcagggactgcgcacttttttctatcagtgttttatactgtttcttcatccccactgcggtgcagccgccgcggatgtatcctgtaacggtattgatatcctttacatggagcattgccacggatttctggcccgcagccctggccgccttcttcaaatccagctccgcttctatgggtatcacgaatacaaaatattctttggacgggctttgggtaaccagagtcttgtataccttttcatgaggaaggtccagcatatccgcaacctgtatgccatcaataaattctccgcattcataggtgtagtgggtataggggattttcattcggtccagaatgcgcatggcattggtttttatttctttttgttttgccaattccgccacctctttcgtgtttgtacctggtcattatagcatatcggcgtttggacgtatactgtgaaatgtgggggatggagggcgtgggagtataaaacggagccatgaaaactgctctgcagtctctccggccccgctttttgtaaaaaaatattaaatccgcacggaaatgttccgcgccttcacaaccacttcgtatgctactataaaactgccgctatcgtttttcctgattctttgctttttcctccatgaaactgcgcagttcttcttccgcagcttcccgggtcagcgaaaagtttttctgaagcttttcacaaatgcgtttttcttccacaccctcttccagattatcctgtatcattgcatggattccctgtttaagcccttcctgaagcccttcctgcctgcccttttcaattccaatctcaagaatattcatctttacagcctcccattcttccgattgcttcacttcatttacaatttcatccaacgtgacaatccgtctatcctttactatgatttcaggattatcaatcgtcgtatttttcatatactgcagcaggcttatcagttcaggacggccattcctgctggtcatattcaggaatattttcttcgtgccgtcatccagcggcaaaccggaaatctcttcgcactgttcagaaaatgtgtattcagctaaatcccgtccaaaaatatcctcctgcgtaatgaaaatgataatagtcgatggcaaatgcttatattttgtcatctttcctgattttaaaaccggagtatccagcaaaccctgataaaatcttgctcttcgcctgacatcatccgtttcggtttcattctgcatttccgtgttaatacggcggtcaagcgtatcccgcgcccaggcatccagccggatagcccgtttcccacttttgttaagtactacctgctccacctctacctcagccagcttcagctccggttcatccagaataatactcagggtgcattcataggccgtcttgttcttcatcacggataaaaacaaagcgaaatcactcaggttaaactggtagttccggggcagcaattgggtagaagtgtcccctgttgttataaggttcataggcattcctctctttctttttccgcagagagaaccatgccttttgctctccctgcttattcatttgtcagcaaggagttcatgcattatcacgcatacgtaaccgggatgtatcttcctcatggcccggacaatctatctgccgttcctatgggattttcctcggcatatgcattcatgcacacgcgaaactgcgtgcagataccggcctgtcagcggaatcgctgagacagtacggcatagaatcttaaaagatgaacagatatgttgaattcattgcttgatccgattgtagcatacagaaatttataacgcaataatatcatataatattttaataaacattttttgttgccaggaaattaccccggcaatttttcactttaaacacaatgcagcaaggcttggctaataatttaccgctatgcttatttacggttgaatgtccgcattgacacagcaaaacacacaacacttaatactatgcaccatgtaagtgccagcatcaaactattccccaaaggcaaatcaagggtcagggctctcaagctgtcaatcatcggtgtcataggctgtatcgaagcaaacctgccaatacctcttggcatagtgtcaacaggtgcaaatcccgaactcgtaaaaggtaaaataaaaagggggaacaatagtccggttgccccttctaccgactttgaaatcgtcccacaaagtacagcgatcagcgtaaatgtaatatttatcagcaaaaggagcgctataaccaaaacccaatccacaaaccctgcttgcggcctaaagccaagaatgggagccgttgccataataacaatgtttgaaataatcccccgcatcactccagcccctgtatggccaatcaacacagcagattttgaaacagacatacagcggaagcggtctatgataccctttgtcatatccgctgcaacattcattgccgaatattgagaggcctgggcgatgctttgaaaaataattcccggcacaataaaatcaatgtaattataatcccccacatcggatatgctgccaaagaccgtgccaaataaaagaattaagaaaaatggtatcagcgttgccgtcaggagtgtttcaggattccgcaatgatataattaaacagcgtttgaacataacccatgaatcagggaatatatttctactagattttttcatattgatttttctccttttttttcatcaatcagtgttaaaaatacatcttctaatgagggcaggttttgttctatactgtcggcaaaaattccattttcatttaagagctttatcgctgaaccggctttagcctcactttcaaaaacaagcctcagccctctctccggcaatatttctttaagatacctcggcgtgccctctgcaatgattttaccgtcatgtaaaatagcaatatcatcagcgagaaattcagcttcttctaaatattgtgttgtgagaaatacagttgttcctgtccttgctaaatcctttaccaaatcccacatggcaatacggttttgtgggtcaagccctgttgtaggttcatcaagaaaaagtacattggggtttcccataaggctcatagctatatcaagcctgcgccgcataccccccgaataggtggagactcttttgttggctgcatcctccaatcttgaaaaagacagccactcgtttacggtgcttttgaggtttggcagacgtttcaattgtccgataagcgtcagattttctctgcctgtcaaaacttcatctaccgccacaaactgccctgtcaggctgatacactcacgtacattgccgccattcgtcgccacattaaatccattaacaactgcactgccgccgtctgctttcaatagtgtggaaagaattttgataactgtcgtttttcctgcaccattggaaccaagcaaagcaaaaatactccctttatcaatagtgaaactgacatccttcaaaacatggttttccttataggatttttgcagcccggatacttcaattattttttctgacatgttcctcctcctgatatacatacacatgtatgttgtcattgtaaattttactgtctaaaaaaggcagtaaaaaacagatttattctcttcattttaactgctacatacaatgtcccccgctttaatataaaatcagccggaagcgccgttacatctggcatcatccggctgtgctatacagtcaggatatcgtatttgtcattgcccggcacgcaaggtacggttgagaaaccgataattgcggcagtgcaacctgcagttttctgcgcatccggcgcaaatccctcacgatggagtaaaagtgaaccgcaaccggcggttcggaagatcagagcaggcgggtcagctgtccgctttaacctctgctgttttaataatgaatttcacgctgccgtccattccctcaggcagcctggtgaaggtcttgtattcctttccggaatccgccacagccttcagacggtccgtcacggtttttgtattatctccgaaaatatccgtcagcttactgattccttcctcgtcaaagcggaacatgccatccttcagggttcctgctccttcgtccagcgccagcgccccttcctgcagggaatgcgcgccgttttccagggtatccactccgtcggtgagcgtcagcgctccttcatccagctttcctgtcccttccaccagccgggcagtgccttccttcagctgtgtggttcctgttttcagagtaccgctgcctgcagaaagcgtagcggctccgtttttcagttcatccaggccgcccttcagcgtcccggctcctgaatccagctttttggcgccctcattgagttcccgggcgccggatactgcgcctgcggtcccttccttcagagcattggcgcccgcaaccagggcgggaacccctttttcctgatccgccaactgcgttaacccgccgtccacctgcccaaggcccgcataaagagcctgggtcccggcactcagctgagcgcaatactgcttgatagtaacaatgtccgtcgctttctgcaccgcatcgctgctcaggccctgaaccacctgatacacctcctccagctggttcagctgttcgctgtaagcggaaacctgtgcttcatagacagcctcctccctgacggcctcccggtagctttccaccgcccccgataccgcgtccgcagagatggttgccacctccttcgtctgagtgtccaccgatacaatatcgttgccgctgacactttccacactgcggccggtcactacctccacctcttccgtggaaggctgacatgcattgtccagatcggcctgagcctggctgcaccgggatctggcggcatccagattagcctgggcggtctccagcgctccatttgcatgactcatctgctcctctatcatctggattacgggcgccaaatccttttcataggtatcaaaataggcgattaccttttcatataatgttcccatgttctgcgcgattgcctcggaactgcccaggatcggcggctggtcgccgcttccggtttccatggccgttttcaacgccgaaatcccattattaacaccggcaattccttcctgcagggcccccgctccggcatccagctttccggcgccgtccaccaggctgccggttccctctaccaggctgtgggtgccgtccttaaggcttccggccccgtcgcttaaggaggaagcgccgctgttgagcttatctgctccctctgccagtgaagatgcgccctcttccagttttgcagcgccttcgtccagttctccggacttttcatacagctccccggttccctccttcaggctcccggcgccgtccttcaggcttaccacaccatctgccagactgtccgtcccttccttcagctttgcactgccgtcctttaaatcggaggtcccgtccttcagttcattggatgcggactgcagatcattcatggaatcattcatttcctccagatccagggaatccgcgagggaaaaatcagaaagcatgtcactcatggctattgtcatagtcattcccagagaaaaattctcagcatctgcgctgacctccagataatccggaatggcaagctcctcctccgcctgtttcttctccgcctttgacaaatcttttttaagttcctcccagttcaggctttccttcagccccggaaaagcgatccccaccacaatgctgttatttccttccgacagcagacggccgttggtaacttcgatattggaaaaggtatcctggggcaaaagcataccggacagcatggcaaaggggatatgtatttcttcctttctgccgtttacttcaacggttctcgtttctttattttcgtaatccatacggatggtcacccgtccgctctttcccgcgatttcctccggctttacttcttttccgtccagcttataggtaagcttcaccgcaacaggcagttgtttttccgtacttccctgataataaatatcggctccgtccgcctgccaggtaagtccgtttttcccatctgagacaaatgtttcgtagcccttgacattctcgatattctgcaaatccgatgcatcctgcagggtgctgtcaccgtccttatttttcagccagtcgcttacaatgatcttctccacgccgccggaagcgtccgccagaacataaacggtctcctcctttcccgtttccgcactgtgggaaggcgctccctgactgctcagcgcctctgtcagcagcgcctcttcctccgaagctgtagcagcggtttcctccgccttctgcgccccgcaccctgtcaggccaagcagcagcgatgcgctcagggtaagactgagtattttctgatatccgtttctttttattctattcatgcctgtgaagcctcctgttccttttctgctttgtttgttttcattccccaggtagtcctccggatcagcgcgtcaaataccatcagcatggaaggaagaataaaaataaccgatgccatacttatcagcgcgcctcttgccatcagggtgcacagggaacttatcatatcaatattggaataaagcccgacgccaaaggtggccgcaaagaaggacaatgcgcttaccataatggattttacgctggtctggcaggccacggaaaccgcctgcgccttatccgccccgcccaggcgctcgcttttatatcttgtggtcatcagaatggcgtaatccactgtggcgcccagctgtatggttccgattacgatggaggcgataaacggtatggccgtgtccgtataataggggattcccatattgataaatatcgccagctctatcaccgccaccaggactaccggaagtgtgagggatttgaataccaacaggatgatgagaaaaataaccccgatggaaacaatgcttaccgtgctgaaatcatgatccgtaatccggattaaatccctggtacatggcgcttctcctaccagcatcgcgccgggatcatattttttactcactgcgctcagcgtatcgcactgagcgttcacctcatccgatgccaccttataagcggatccaatgagcaaaagctgccagttttcatcctccagggtctctgtaagctcagccggcaccatttctccgggaagcgccgtccctttcagggcattcagccccagcacccattttacgccgtccactttctcaagctcctccgtcatatgccggacatccttgggagaaacatcgccgtctaccaacagcatgtgcgtggcattcatatcaaactccgcattcagcttatcgtttgccacgatactggggagtgtctttggaagcgtttcatccaggttataataaaccttcgtatgcgtatagccgaacactgccggaatcagagccgcaacaaaaagtacggcaaacaccctgtagtgcttagtaataaatgcgccgattcccttcggctccggcagcactgccctgtgccttgttttttccagcgccctgtcgaaaacaagaatcatggacggcagtatggtgatgcaggcaattaccccgaacacaacacccttagccatcacaattcccaaatcaagccccagggtaaagctcataaagcaaagcgccagaaagcccgccaccgtagtaatggagctgcccaccactgaggtaatggttgccgcgatcgcttttgccatggcatcttttttacccgtaccggtctgctgctgctcctgatagctgtgccagaggaagatggaataatccatggttactcccagctgaagcaccgcactcaaagccttggtaatataggaaatctgccccaggaacacattggttcccagattatataaaatcgccatccctatgctcagcagaaacaaaaaaggaatcagataggaatccatggtcagggacagcaccaggcaggaaagcagaacagcaatgcacacataaaccggcgcttccttttccgacagattctttgtatccgtgaccaccgctgacattccgctcaggaaacagtttctgtccgcaacccgccgtatctcctcaatggccttcatcgtcgcatccgaagaagtcgtatcatcaaaaataatggccatcaaggtactgtccccatgattaaacgcctcatacagttcatccggcagcatctccatgggaaccgaaatatccatggccgtatcataccagataaccttctttacatgctccacctgctcaatctcattcttcagctccgtaatttcctttggcgtcatcccttccgccacaaacatggaaaaggcgcctgttccaaactcctccgtcagaatatcctgccccgccatcgtctcaatatcaccgggaagataagacaaaatatcataattcacccgtgttttcgcatagccgataacggacggcaccaacaacactaacgccgctatcaggatcggaatccttaaagccacaattctccttccaaacctatccattccctgcacctctgttttttatcattatatgaccattggtcatttttgtttacctgtattgttatatcattttaatgaccattggtcaatattttaaattattaaataactataaagcctgatatttaccgtttttcacccgatgcattatccctccggcctttctctgcatagatattacagtgccgcggcccttttgccccggcagtccctttttttctgtaaagcattttcatttgaaggaatctgccttataataagggaaataaaaaacggcagggagttatggcctatgggaaaagcggaacggaataagaaacagaaaaaagacgcgctattaaataccgcattcgaactgttcaccagtaaaggaattacagacaccaccatttccaatattgtggatcgggcaggagtggctaagggaaccttttatctctatttcaaggacaaatatgacatccgcaacaaactgattgcccataaggccagccaggttttcacaaaagcggaggaggcgctccatcagacggacattacgctgctggaggataaaataattttcctggtggatcatattctggagcagtttaatgaagacaagatccttctgcggtttatttccaaaaatttaagctgggggatctttaaaaatgaactgcttcattcctctgacagctctgattttgatttccatgagctgtatacctccgtattcgaaaatgaagcgtcagacaagctttaccggaaccctgaggtcatgctttatctaatcatagagcttaccggctccacctgctacagctccattttatatgaggagcccgtgcccatacaggaattaaagccgtacctgttccagtccatccgccagatcatacgcggccaggaaattacaggcgacgctttagaaaataccagggtgaaaaaagcataacattgaatttggttactgttctcacaaaaatccgatattagttgatacggaataaagaatatgctacactaaagctacatcagtttttaaccgtatataaagaaagaaggggtttatatgtgtatcaacacaaaaaataagaagaaagtttttctccatgcaaagccagcagattgcgacggttgcatggagtagatatggtcgcaaaataataatgctggcttttggaacttgactataattatcaaggaggaagcctgcatgaaatatctgaacgcaacatctgttcttccggacactttggtaaaagagctgcagaactatgttcagggtggttacatctacattccaatagaacaggaacagcaaaaacgttggggagaagcttccggctatcggcaggaactggaacaacgtaatcagcaaatcaaaagggaatatcggaatggtgtttccattgaatgtctgactgaaaaatactgtttgtctttatatactgtccggaaaatcatatatcaaaaataattgaaggaggctgccagtcgcggcctcttttttttatacatattggttcggtagcatactgtatatagaaaaaatattccaataaccgtagaataaaagggaaatctataatgagtttatgaggtgtttactcaggctttatgaaaggaaacaattatgtgtaccagatttgtttatcatggaaatgatatgattacaggctttaattttgatattgacctctctgcatggaagcataaggtgattatggatgaggaacgtttttatattggaatcttacgtccggatggaacctatcattcttatcatggggttaataaaaatgggaatgtcggtacgctgctttacgtgcacggcaatcctggcggggaataccaggccagcccggactgcatgacaattgcagatttgacggaagaatttattaaaggacagattacatttgatgacgcgcttcagcttgtaagggataaaaagattacctatgcaccggacgccactatgcaggcactgctgtcagatatccatgggcgtgttttgataatcgagccgggattgggatatcgggaagaacataagaaatattccctgataacgaattattctctgatagatccggaaagcacaaaaaaatatattgtgccgggtgatgaccggtatgagcgggctttgcagttattggactgctgcggaaatgatttctcggtatccaacgcatatactttgcttcatgccgtccgtcaggagggtgcatgggctaccagagtatcctttgtttactctgcaaaagaacaggcggtgtattatgtggagaataaccgttttgaacacattacaaagtatgtatttccttgaacggataaagagcagaactttataagctgtgaagctataaaactaagaagctgtgaaactatagagcaatgaaactatgaagccgtgatactaagaagctgtgaaattatgatttgataaattgaaaacagggactccggagaaagccattcggataaacggaatactttacatccatgcaggcaggacagccgagagaaacataagaagaaaaataaagaatactgttttttatataaaaaaccgccgccctacggcaaaactggtgtgataccagaaccgtagggcggcgatgttgttcaccgcattattttgcagctcttgcttccctgatcttatcggcaagaatcggaacaatcttattcagatcaccaacgatgccgtaatcagctacgtcaaagataggagctgtctcatccttgttgattgcaacaatgatgtcagattcttccatacctgccagatgctgaattgctccggagataccgattgcaaagtatacgttggggcgaacggttttaccggtctgtccaacctgaagatccttgggcttccagcctgcgtccacaactgcacgggagcagcttactgttccgccgatagcttctgcaaggtcatccagaatcttgaagttctccgggctgccaactccacggccaccggataccaggatttttgcatccataatatcaacggtatcaactacggatttaacaacttccatgatttcaacatatttgttgtccggggtaaagccgggattaaactcttccactacagccttagcgccttctaccttgggtgccttctgcataacgccaggacgaacagttgccatctgaggacggaagttcgggcaggcgatagtagcgatggtatttccaccgaatgcaggacgggtcattaacagctgattatgtttctgctcctgtccgggaacgggatttaacgggaaatctccgatatccagctgtgtacagtctgcagtcagacctgtatggattcttgcggaaacacgggggccaaggtcacggccgattgcggtagcgcctaccagcatgatttccggtttatatttttcaattacagaggaaagtgcatgggcataaggctctgttctgtattccttcagttcaggatcgtcaacaacgattactctatcagcgccatatgcagccagctcgtcagccagtccttttacttcataaccgatcagtactgcggttacttctgttcctaaatcctttgccagttctttccctttgccaatcagttcaaatgcgattccgcttactacgttatcaacctgctgtgcaaagacaaatactcccttatattcttctaaattcatccttattcaccacacttttctattaatattaaataacgtgtttttcctgtaattttcctgtaataaaggaagctgcttcatcaggagtatcaaaggtaaacttctctcctgctccctttcttaccttatcagaagccttagcgatctgagtcggtgatcccttcagaccaaggttggaatcgtcaacatccttcagatctgctcttccccatacggtgatttctttcttgtatgcatcgaagattccgccgggtgtcatataacggggctcattcagttcgcccagagctgtgatcaggcagggcattttagctttcaggacatgatatctgtcatcgaactgacgctctacgataacattttcgccttcgattttgatattctgtgcataggaaataaccggaattcccagatgctcggaaatctgaggtccaacctgtgcggtatcgccatcgatagcctgacggcctgtaataatcaggtcataatccagattgcggatagcgcctgcgattgtctgggaggtagcccatgtatcagcgccacccagaactctgtcggttaccaggattccgttgtcagcgcccatagccatagcttcacggagaacctcttctgccttgggaagacccatggtgataacggtaacctctgcgccgtattgatctttcagtctcagtgcagcttccagacctgccttgtcatcgggattcatgatcgtaagcattgcagctctgtcaagcgtaccatcgggtttgaatttaacgccgccctttgtatcaggtacctgcttaatacaaacaacaattttcattgtattttctctccttgtttataattttcttaagataacagtcgtgccgcagcttatttcagcagtgctccggagattaccattctctgaacttcgcttgttccttcgtagatctcggtaatcttggcatcgcgcatcatacgctcaacatcatattctcttgtgtatccataaccgccgtgcagctgaacagccttggttgtaacttccattgcaacctctgcagcgtacagcttagcttttgcagcttccacagaatatacggactgggtagcctttgccatagcagccttgtaaacaagcagctgggcgcattcaaccttggtagccatatctgcaagctggaactgggtgttctggaaagcgccgattgctctgccgaactgttttctttcttttacataagcgatggtattgttaagagcgccttcagcaagcccaagagcctgtgcagcgataccgatacgtccgccgtccagagtatgcatagcgataccaaagcccttgccttctgctcccagcaggttttccttcgggattctgcagtctgtgaaaatcagttcgtaggttgatgaaccgcggatacccatcttcttttctttggtaccaaaggagaagccgggagttcctttttccacgatgaatgcagaaatcatttttttctttctgcctctcttatcttcaacaacgcttgtaacagcgaaaattacataaacgtcagcttctttaccgttggtgatgaaaatcttggatccgttaagcacccactcatctccatccagataagccttggtctgctgtccctgtgcgtcagtacctgcgccgggctctgtcaggccgaatgcacccagtttttcaccctttgcaaggggaaccaggtatttctgcttctgctcttccgtaccataggtcatgataggatcgcagcacagagatgtatgggcggatacgataacacctgtggtgccgcataccttggaaagctcttccacgcacatagcgtaggtcagaggatcgcagccctgtccgccgtattccttcggaaccggaattcccagaaaaccaagcttagccattttttcaacggtagccctggggaactcctctgtttcgtcaacctcctgtgcaagaggctttacttctttttctgcaaattctctgaaaagagttcttgccatctcatgctctttgcttaaagtaaaatccatgattatttactcctccgtttttatctttattattgcgaaagcagcgggcctgagtcaggaattcccggctccggcggccgcctgcaggggataagccctgccgcttactgcgccttttgcccgccgttccgtaatctgctgcgggatattttacttgctgtagtcatagaagcccttgccggtcttctgtccaagctgtccgccgcgaaccatcttcttaagcagtgtatgaggacggtatttcggatcgcctgtttcggattccagaacttccatgatagccagaacgatatccagaccaatcatatcgcccagagccagaggtcccatgggatgattagcgcccagcttcatagcggtgtcgatatcttctacggaagcaacgccttcagcatagatgccgatagcttcgttgatcatcggaacaaggattctgtttactacgaaacctgcagcttcgttaacctgtacaggtgttttgccgatagctacggagatttccttaattgtttccactacgctttcaggtgtgttcagtcctgcgataacctcaaccagcttcataacaggagcgggattgaagaaatgcattccgataacgggtctgtcaaggccagcgccgatttcggtaatggacagggaagatgtattagtagcgaagatgcagtccttcttgcagatatcctgcagctctttgaaagtctgcttcttgatttccatattctccagagcagcttcaacaaccagatcacaatctgtgcagatagtcttcacacctgttgtgattttagcaaggatagcgtcagcagcagcctgctccatttttccctttgccactctcttagacagagtcttagcgattctgttctttccgtttgcagcgaattcctcattgatatcacacagaaaaacctcatacccttctgtctgagcaaaagcctgcgctataccagaacccattgtacctgcaccaataataccaaccttcatctgattaaacctcctacaagatatgttttagttgagccgggcgtggaccggattgtaaaagctgagcggtgagcttgctcaccgaccagtttttacaatccggcccacatgcggcgaagccgcatagcgaaaggccgcaggccttgagcctcccggcggatttccggtaaccaatcccttaagtccttaaatcccttaagtccctaagaaattacttattcaaaaacttctccactttcctcttctccaggaaagcagccattccttccttctggtcatagctctcgaagcagtcgccaaacagcttctcttcgattacaatcgcctcatccatatcagcgtccagaccatcattaatagccttcttgcagtttctcacagcgatcggcgcattcttggcaattcccgccgccatcttctcagcagcagccataagctcgtcctgcgtataaaccgcattcaccagaccaattctcagagcctcgtcagccttaatattccttgccgtataaatcatctgctttgccattccaggtccaaccagacgtgccagtctctgtgtgccgccgaaaccaggtgtgattcccaggccaacctcaggctgtccgaatactgcattatcagaacagattctgatatcacagctcatggaaatctcacagccgccgcccagtgcaaagccgttaacagctgcaataacaggaatcgggaatgtctccagcttacggaaaacatcatttcccttcttaccaaaggcctcgccctccgccttggtcagagtgctcatttctccgatatccgcgcctgcaacgaaggattttgcccctgcgcctgtcagaatcagacatcttacctcttccagattcacagcatccaaagtttcattcagttcatcaagaacctgggaattcagagcgttcagcgctttttcacggctgatggtgataactgcgtaggaacccttctgttcatatacaatgtattccatagtactcatcctttctatatcaccgtcttttatgacgggaatttttcagctacccctgtgcataacgaatgattagcagaccgcaaagtccgctaatcattcagtttagaagcctatatcagtctctttctacgatggttgcgcagcccatgccgccgccgatgcacagagttgcaagacccttcttagcatcagatttaaccatttcgtgaagcagagtaaccagaatacggcatccggaagctcctacgggatgtcccagcgcaatagcaccgccgtttacattcagcttgtcattgttaatgccaagatcatgtgcaacagcaagagactgtgcggcaaaagcttcattggcttcaatcagatcgaaatcatcgatgttcattccggtcttagccataacctttctggttgctgcaacaggtccgattcccatgatggtgggatccacgcctgccagtgctcccgctacccatgttgccataggggttacgcccagctcttttgccttttcttcgctcataaccacaactgctgccgcgccgtcattgattcctgaagagttcgcagcggttacgacgccgtctttcttgaatgcaggacgaagctttgcaatgccttctgcggtggttcccggacgagggccttcatccttattgaaaataatggtttcttttttcttcttaacttctacaggaacgatttcatcatcaaactttcctgcttcctgagctgcaacagtcttctgctggctccatgcagcgaactcgtccagctgctgtctggtcagcccccactgctctgcgatattttctgcagtgatgcccatatgatactgattgaatgcatctgtaagagcatcgttcaccatagtatcaaccatagttgcgttgcccattctatatccgtaacgtccctgagggattgcataaggagccatggacatgttttccataccgcctgcaacaacgatatccgcatctcctgcaagaatcatctgtgcagcctggttcacacagttcagaccggaaccgcatacaacgttcatggtaacagccggaacttcgataggcaaaccagctttgatagatgcctgacgtgccacgttctgtcccaggccagcctggataacacatcccatatatacctgatcaactgcttcgggagcaactcccgctctgtttaaagcttccttgataacgatagcacccagctccgctgccggagttgtgcttaaggccccgcccattgtaccgatggctgtacggcatgcacctgccaaaacgattttctttgccatgttttctcctccatattcattaaaaactgcgaatttactgggttttgacggtattgttaattttttgtcattacccacagcctttattatagcatagagaatatttaatagcaaggatttttcgatgctcaataacaggaaactttccggcataagaaacctaattaaaatagtgtaaaaataaataaatttttaataaacattaagttttgtaacgcttcggatatgtcgctgcacggacgcacctctcggtttttcagtcatataatgataaaaaagactattttgtctctcaagaggttagatatggccactgataatttaggttccatcgtatccctgggtaatgttctccggattgacaacgctgttattgatgaggtttttttctcaaataacaacaccggatatatccttatctcctattccgtcccatggcagagcggaattaccacgacagaccagctgcagcttaacgtaaataacaataccgttatcctgaattccttccgactgccgatatgtctctgtgatctgcgcgagggaatgcgggtcgatgtcaccttttcgccccgtatgacaagaagcatcccgcctcagagcaatgcattttcaattactgtaagacgcccgtcgcggcctcccgttgcgccgccaagtgtaacaacagcacgaatcctctggattgatgcaaataataaccggttgatcaccgtttcgcaaaacaatataaacagacagatggtatttgtcataacaaattccacaattattctgaacaggaacggtttcccaatccctctgcgcgctctccgccccggacagctggtgcagatatcacactctaattttcagacggcaagcataccgccaatcgccacggcattccggattcaggtaatatagcatttatttaaactgcctgccggaagtatataaaaagggagcctcagcaaaaattccgttccagcggaattttcctgccatggctcctttttatcatcattcgcaatatatacggtttcaacagagatttactttttatctgcgatatccagtcctatcaccacccatggcagggcggctgaagtaaaatctcccatattgcatcctttcatgcactccggcattctgcggacagcatcagttcaggaaaacggcaaccgcattcgctccaggacctacatgcaccccgattacagaaccaaccggaactgtctttttgtattccgcatcaaaatgttccttaataaatgcctcaaatccgctgacacattccttttttcctgtaaagccaagattgtagcctcttgtcttgtccatcccgccgtctttctcaattgttttaagcaccttgtcccaggcactcttctggcccctggcaagcccggccacacgcacttccccgtatctcacggacagaatgggcttaaggttaagcgcgcttcccactaccatgcccgttgtggacaggcgtcctcccttctggagataaagaagtgtgtctacaatcagataaatgcagatcttctctttttctttttcaagaatttcaacaatctgctccgctgtctttccttcctctctgagggcaaatgcgcgatccagcaaaagctgtgtccccagcgttgcctgcatgctgtcgattatgtaaatcctgtcatattccacaatatccctggcaataagcgcgctctggcaggtaccgctaagcttgctcgcaagaaggatgcatatcacatcgtctcccgcttctttagcctccctgaaatactgcaaaaatgcttccggagagggctggcttgtcgtgggcagttcctccgctgaagcaagcttatcataaaattcctccggtttcatgtcaacaccgtcaaaatattctttttctccgaaaagtactttaaggggaaccagggtgatgcccagcctggctgcctgttctgttgtatagtcgcaggttgaatcacagataaaacggatactcatttttactcctgtctgcgcgtaaatacgctattatcaaaaacgggccgaatggtggaaatcttcagctttattgatttaatgttactgttttaattggggtgtgggtcatcgggttatataaagtatggtatattttagaattaagttcaaatattttgattttcaaaacatttgaaagcatagcaaaatttaattaggatgtcaataatttttttcagtttactcttgtttttttgatttattcttgtttatttatgctgattgctattgtgggtggaatattgtagaataacataatatatggaagatcttatattatattgatcaataaggagtcctattatgaaaaaggattacagaaataaagggtttacgcttgttgagatgatagttgtaatagttataatagggattcttctggccatattggtgccagggatgtttaagtatatacagaaggctaaggagcagcaggcgattgtggagtgtcgggcggtggttacggcggcagatactttagcattggaattatatgctaaggatttatttgatgaattaatctttttctcaaattatcaagctgatatccttgaaaaagcagaggtcaatggtagtataaaatctttatcttttcaaaaagataaaccttctttggaaaatcttacttatatgactaaatcgaacataaaagttttatatgatataaagcaagcttctgtatatcaaattgtatcagaaggaagcttctcttctaatgcttcaggttatcacgatttttcatcggatgcattggttaatcccagtatagatagtattaaagatattgatcttaaaaataaagctttacaaaaacaattttatgaaaaatatggcaatgcaaccttatccgattctgaaaaagaactttttaatagtattaatggtaaaataacctgggacaattatcattggaatccattatatactaaagatggtaaactaattgtcgttgccaataactatccttataattcatcacaatcacattatcccggaacatctataatcttttatgaagataactattactatttttatcaaagtgaaatacatcccattggttcatcttatgtttcaattgcatttaatacagaccaattaaaaaatgctccaatagttcctccaaaaggtgctacttctagtacaaacgttaatacttggataaaaattgaaaatccttagacatattattcagagaatcctctaccataataatcaggattctctgaaatcttttttggcaacaacttttgctttaacaagtctctcctcttccccacgccccccagcaatcctccccaacagcacctccaccgccttttccgcaatcgccgcctcatcctgcttcacatgcaggaaggccggcccatagggcgccagataatcttcatccacacaagctaggcggatttccttatccagagagattcctactttccccgccgcggcagtaatggcaggcacaatgccatactcctccgcaattatggcatccatttccgttctccccttttccaggaaccgtactgctgcctgaattgcttccggacaggggtggttatccaagagagactccttccctccgcctgacggcagcacacagattccggcttcagtcaggccgagacgttccatctcattaataaacccattccgccgttcctgaactgaaatcgcttcggtatcctccgtagtaaacagagctatccggcggcagccgtcctcagccaaagccctgaccaaagcagctgttgccgccttattgtcagttcttaccgaaggtaccgggatgcccttcatcttcttatcaataagaaccacaggaaaatcatccagatacagctgcaggatagcaggactgtagttctttccatgacagggcatgattatcatgccgtccacatgaagcgacataagaaaatggatctcctccgtttccctctccctgtctccataggaaaatctgacaatcaggctgtatcctgtctttttggcgagacaatccatgcggtacatcatttccagcccgaagggtgttgatacatgctccagtaccaatcccagcaaatgatctttaccgcccttttcccctgccgccttctcctgttttctcacaaagctaccattccccggcactcttttcacacatccgctttccgccagcatttccagcgctttcttcactgttattgcactgaccgaaaactctctgcacagttcatcatcggcaggcagtttttcaccgggcggataggttccgttctggatacgctccagcaactcctcatataccttctgatataaaaatatttttcccattttcttcataacatcccttcaccgctaaacctgaatgccgaatatgcaaacacgcataccttaatgctccatcaatcttccatttcattcattgtcaataaaatatattttattacaaatacagccatatatacaacaagaaaaatatactttactcctctttttcatgtcacattccccagtaatcccttccgctttttagcagaatcagagaaaaaaatcagtccgatttacaaacaaatacccctatgctacctttaaagcaggtcttacaccatttctgtcgaaaatggcggcaagacaaccaccctttacttaaaattatcccagccaaaggaggctacccatgaacactaccaggaaaaccagtcccttccgttatgctgtcggcatgttcggcacatccatccccatcaatatgtttaaaacctatgccgccgcattttatgttatcgggcacggcgttaccacagcgcagttttccatggtgctgttcctgtatacctttgtggatgccattgataatccggtgtacggctttctttccgacaggacacggacacgctggggacggcgcaggccctggcttgttatcggcgcgccgctgctggcgctttgcttcattgcctttttcaatatcccggctttcttaagcggaagcggaattttttcctatatgctgctgatgtacatactcaccggtacgctggattccctcatcaatgccaattacggagcgcttttcccggagcttttccgttccgatgcagagcgtgccaaatccaacgccatgcgccaggccttccagctgctcgccatggtaatcagcatcgcactcacgcctatagtaacggatgccctgggttacggcctgaccagtgtgatttacgggcttttagccgtttccgttattctctactgcactttcggctgccatgaaaccgcacaggaggaagaactggaaaaaccacgtctgctttccaccctgcgggatcttctcaccaaccccaaattctggattttcgggctgaccaatgctttttacagcgctgccatggcgctggtgatgtcggcggtccctttttatgttaaatatacgctggggctggacagcatggcaaataccatgctccttggcgtggtgcttctgtttgccatggccggggtatcggtctgggctttctttgtaaaaaaacgttctttaatgcccatatggcgtacggcgctcatcgcgcttgcgctgtcttttatcccgctctattttgtgtccggttttgtgccggcgctcgccgcttcctgcctgctcggcttcggctactccggcgccatcaccaccatggatttggtgggcgcccgcattatggatgaggatacccggaagaacgggctgcggcgtgagggcacctatgccagcgccatgggctttatgaaccggctgagcggattttttacaagctttgcctttcttttggtgggctggctttatggttttgaaagcggcgacatgccgggggcaaggccccatgacgccgcccgttttctgatggtggtattcccgctgtgcgccatgcttttgtgcgttgtgtgctcccgtttcctcaaattcccggaagcgccttcccaggcttcgcataaacagccggaaacccgggaagcgaaaaagtaatatccgaaaggacaattcagacaatgaacgaacggtatctgatcatcaatgcggacgactttggcctgtgtgaaagcatgaaccaggcggtgcaggagcttttccggctaggggccatcacctcttcttccattctcagtcctgcgcccagggcggctaaggccagtgccctggcggcacagcagaagcttcctgccggcgtgcactggacacttttttccgagtggaaggaggagctttggcctgccgcatccttacagggaaagcacggttttcttacggacaacgggtttctgcctgcggacggaggcgctgcggcaaagcgcgcggcttccagcgatattacaagagagttggaagcgcaatatctgcgcatggctgctgcaggatgcattcctgatcatgcggacagccatggcggaaccctgtatgggattaatggaaggctttttttcataaatgcattcaggctgtgccggaaatacggactgcccttccgttttgcacgtacaaccgccttcctggagaggcagtttgcaggaagggtgtctccggcagtcacactggcccattcgggaattgtatttctggcggagcgtatgggggtggctctgcccgacgatttcatcaccaatccttatcctgtggaaaaaatcagagattacgaagcgctctgtcgttattatgaggagcagttaagaattgctcccgcaggcattaccgaagtattcctccacccctccgtcccggacggacggcttctggcgcgcacgccccagtggcggaagcgggaatgggaatattattttctcaaaagcggacgacttgcccgtctggtagaaaaagaaggctttataccggtttcctggagcagcgctcctttcgaggagctgcgccgtaaagccgctgatttttccgagacgccgcattcccggcagcagaagcagacaatcccaacggaaaatatcaacaggagaataaaacattatggataaaataaagcatctcacccttaccctggacaaatcccaggaacgcggctacatcaaagtcccctttcaggtggaaaaaaatacggaaaggatagacatccgttaccgctatccgtcgtctccggtcagcagcgaagggaattactgcatttccggcgaaccctgtaccattgatttggccgtcatgctgccggatggaaccatggccggggcctccggttccgacagaaaccacgtctggctgtccccgctgggaagcagcgccggttttctttccggtgaactgccggaagggacctggcatatcatcgccggcgcctatcatgtgcccgcagaaggggtcaccgttgaatatacgctggaatttacggaaaaaaagcgccggctttttaaaggcgatacccatgtgcataccaccgcttcggacggtatcctgacgccggaagaggctgcggggctggcaaaacgcatggggttggactatctttttttcacagaccacaataacagcgcacagaacgaaaatctgcccgactgcgatgacattacgcttcttcccggcaccgaatggacgcattacaagggacatgccggctttctcggcgtaaaaagggctttcctgcgtccttatttcacaggctccccggaagaaacggatgcacttttccgggaggcgggggaacgcggcgctttccgtatcatcaaccatcctttctgccctctggtaccatgggaatggggctttgcccttccctttgacggcctggaggtatggaatggcgtcatgtccgaacggaatgaaagggcggcgggctggtggcatgcccagctgtgtgccggccggcggattccggtcaccggaggcagcgattaccatcgccccggactgctgggcagtcttgccatgccctgccattgtctgtatgcgccctcccgttccccgcaagacctgctgcaggcgctccgacggggaaacggctttatttcctatctgccctccgggccgatggccgacctgcaggccgagggaacggatggaaatgccgcctccttcggggattttgcagttcgcggttctgaggtttcccttctttttaccggcctgcaggccggggatgaaatccgcctgattacagagaaggatacagaaatcctgaatgcgccgaagggcgcggtacagctgatgctgaagcgtaattatccggatacgctgttcctccggctggagctttaccgcagctatgcgcccggccttccccctatgaaggccctgctgagcaatcctgtttattttggctgaaaaaagagaggaattacttaaaatatggatattactgcaaaaaaagttattgtggtatttaaaacccacctggacatcggttttacagggctggcggaagacgtgctccgccggtactgtgatgattttatccctgcagcggtggagctggctttccgtgtcaataccggggcgcagaaaaaattcgtctggacggtaggctcctacctcatacgctattatctggagcatgcaaaaccggatgcctgcgcccggctggaacaggccatccgcgccggcttcatccgctggcacggactggcctgcaccacccataccgaactgatggacaggcggctgatggattatgatctttccatttcacaggcgcttgaccgccgtttcggcgtcaccacgctggctgccaaaatgacggacgtcccgggacataccataggcctggttcccgcgctttccgacgcagggattgaattcctccatatcggggtaaatgcctcttcccgggtgccttccgtcccctccctgtttcgctggcgttttggcggcaaagaaatcacagttaactatgccgcggaatatgggaatgtcaccctactggaaaatggagccgcgctcgttttctatcatgcccatgacaattccgccccgccctctcccgaagagctggagcagctgtatgcccggctggcagcgcagtatccccaggcacatatcgaagcgggcactcttgatgaattcgcggaggaaatccggcaggtgagggacagcctgcccgtcctggaagcggaaatcggcgatacctggattcacggcgctgccagcgatcccctgaaggtatcctggtacagacgcctgcttctcctgaaggaaaaatggctggctgagggccggctggcacaggaaagcccggcttatgatacgttgatggaaaatctcctgttgatctgcgaacacacctgggggatggataccaagaaattcctgcttgatttcaccaactgggaaaagaaggcctttgccgaagcccggaaaaaggatatcacctcctacgcgcttttttctccgcagaaccagcatatcttccaggcgctgctccccgaactggaggattacaaaaaggtccgcggcggacagtgctcctcctattccctgtttgaaagctcccatcaggaacagagggactacatcacccgcgccctgggggcgctgcctgatgcgttgaaaaaagaagcgcaggcttccttttccttctcctatccggcgctgcccgattgtgccgtgccctgccgcgcctatacaccccttcaggccggcccctgtatggtaaccgttggatccagcggggagctgacgcatatttccttcagcgccaacggacaaaaacgggaaatgtccggcgccatcggtctgctggaatatgaaacctttggcggaaaggaagtggacgactgttattttgaatacggccgggatttgggggagaacttccactgggcggagcctgacttcggaaaaccgggacttcgctaccatcctgaaatccaacatcgtacctgccgtcctttccccgcttccatccatgtaagcggaggacagctgtatatccgccttatatttcctccggaggccagcgagcagtatggctgccccagggaggccatggcagtatacaggttcaccgaaggaaatatccatctggaactgttctggaaggataaggatgcgctgcgaagcccggaagcattgtggcttggcatacgtccggaggtggaaaatccctcctgctggcagatggttaaaagcggcgcggccctttccccttccaatgtggtttccaacggaaaccggcagctgcatgttgtgcaggacctgtcctatactggcgcagacagcaggatccatatcaccccgacggatgcgccgcttgtgtctttgggcggtaaaaagctgtaccagccggacaacagcatgcctgagctttcccagggcttctttttccttttgtacaacaaccggtggggaaccaattttaaacagtggtttgaagaagatatgcggtttgcctttgacatcagtttatcttagctgcgccctccgggtacgcaaaaaaacgggctgcccatcgccggcagcccgcgtttccttcacagattcatatacttgctttgcatccccgctgttatgcccggatgacaaagccttcttttctcggtttcgcctgaggaagcggtttgtcgccataacccaggatgcagtttccgatgccgatatattcttcgccaagtccccattttttcataagggcttttccttcctccgtctggaaaacctctctggcccggtggatccaacaggagtcaacacccagggagaaagcggcattcatcaggttgcccattacaaggcttccatcctccacacaggttcccctgcggctgtctgcaaaaaccaccaccaccgtcggcgcaccgtaaaaaggatcgctgtcatttcccatcaccgccgcattcatacgggacagctgccggatagtttccttatcctgtaccaccgccatcaccaccggctgcattcccatgccgctgggggcatattctcccgccgtaagaatctgctgcagtgtttcttccggcacctgcgcgtccttataggaacgcacgcttctgcgctccgtcaataccttcagtgtttcattcatttcctgctcctttccccgcgatggaccggatgcccggccaccacgaacccgtacggcccgcgcagcaaatgcgcaggcttgtctgaaccgttacttttttccgccatttacaaaaaccattcgttttttcctctcacagaaaggaacggcgccagcttctggctgagcatctccgttaccggcgcagggagagttctcgctttttccgggcaaatggtaatgcaccgcatgcacagaatacattttgacggatctgtctgcgtcggatctccggctggtatggcttccacgggacatttttgtgcgcagaggccgcaccggatacagtcctttgctatctgagggacggcctgcatgggcttccagcttttatagggacggttccccggcgtcgctttttcctccggcctgttcccttcggccagggtcttcagcttatgtaaaatctcaccggcaaattcggcgatttccctgcggtcctgcccatccggccgtcccgccgccagctgtgttacgatggaatgctgtgcaacgagagccgctgaagccagcctggaaaagccctgctgctccatcctgtcatccagctctgcaagggcatcctcataagcccggttcccatataccgcaagggaaatgaaccaggcgccgtttccctgcacacgggaaagcctttcagccatcacaccgggaagccggccgccgtaaaccggccccgccgcaatcaccacatccgatggtgcaaagctgcgctgttcccccaaggggagcgtcagatcatattcctccacctgcgccgccagctctccggccagcatcagagcggctttcctggtatttcccgccggactgaaatgtaccacatatactttgtcaagcatgtaaaaatcccccgtttcctgtttgtagccggcatcataacagcccggataaccagactcttgccggccgcctgctgccgctattgattcctatggccagcggctaaatttttccggctgtatgaaccattccatatcagttagtataggttcctttttgcctgatgtcaatcggccgcaggctctaagctgcaagctctaaattacagactctaaacttcctgcagaagaagctgatagcttcccgcctccagggtaagggacttcacgttttccagggaaagtgccttctgcgcttccggctcagcgccatccacagccttcaggaccattccatccggcacaataaaccgggcggtgcagtcaaaggggatacggacctggaagcggatgccatcttcttcatatgcccattcactttcgtaaacaccggccgcagaggaaaattcgcccttcacccagcccagcctcctgtccgggcagggcgccaggaccgcctttttaaagccgacagccgtttcatccggcgcaatgccgcagacgcttctgtaaatccattcggaaacagcgccgtaggcgtaatggttcaggctgttcatgcctgtgccgctgattttcccatcaggcagaacggaattccatctttcccagacggtggtggctcccatgttcacctcgtacagccagctgggataatcctcctgtagaagcagcgtataggcttcttttaccagccccgcctttgtgagtgcctggcagagataggcggttcccacaaaaccggtattcagatgcattccattctcctgcagcatttttttcaggcgggccgctgttttttccatgaattcttcagggatgatgtcaaaataaatcgccagcaccagcgccgtctgcgtatcgatcgccacccttccgcccggcgtaatatattccttgcggatagcgtccctgacctcctgcgcaatcctgccgtaataggcttcgtcctcctttttgccaagcacggctgccgctcttgcggtcagcagggaggaatacaggtaatagacggaagccacataataaggatcggttcttccgaagcagctgtccttatccggattatccagcgccagccagtccgcgaaatggaagcccacctgccacagccttccgccgccgcagtaagtctcatccatatggatgatgaaatctgtccattgcttcatattttcataggtttcagccagcaggcctgtatccccgtaaaactggtacagggtccaggggatgatcgtcgccgcatcgccccaggcgcaggaaccggcctctccccaggtatttgccgtcatatccggcgcttcctgccccatattttcacgggccacggaaaggacatccggcacgacaaagggtacggcgccctggttgatctgctgctcataacgcatatccttcagatatttccggtaaaaagccgccgtatccatatgataggacgccgtctgacagaacacctgggcatctccggtccagcccagcctttcatcacgctgcgggcagtctgtaggcacatccaggaagtttcccttctgtccccaaagcgtattttctatcaggcggttcaccttttcatccgctgtggtgatccggcctgttctttccaaatcagaataaaccgcgcaggcctcaaaggcaaagctgtccagattttcctgcgtaagcgtgattccgatcaccttcacataacggaagccatagaaggtaaaatgcgggcgcacatgggcgctgctgccatcggaaatgtaggtgaattccgcttttgcggtgcgtaggttgtccctgtagaagttgccgtcctgcaggatttccccgtattgaagataaatccgggtccctttttccgctttacagtcaaattccacccagcctgtgatttcctgaccgaaatccagaacctgttcccctgccggcgtcataaggaggctgacgggacgcagtctctcatggatggtcaccggaacgctcaggcgctcggtcagcttcgctttcggcgcggatgccctgctgacgggcacggcctcttccttcgcgcaggcgcagattttgccggagcagtcccggaaatccctgttggcatcatagacctcgccgtcataaatattggaaaaaagaaccggcgacggaaggcatttccagttttcatccgttgttattttctgctgtgagccgtccttgtaggtaatcagaagctgtgcggcggcaaggaatttatcgccgtaaatttccgtcaccctagcttcatccaggtaactgaacctgcccttgtaccagccgtccccaagcatgacggaaagcacattttctcccgggcaaagcagctgtgtcacatcataggtctggtactgtatccagaaacggtaatcgttgtaaaaaggagccagatattcctcaccggccttttccccattcaggccggcttcatatacgcccagccctgttatgtaaagcctggcgcaggcaacctcagatacaggggcgtccagtgtgaattcacggtacatcaccggctggatttccttatccagaggggaagcaatccagtccgcgctccattcctcatccccgcagccgccttcaaaccaggcaacactgctgatgccggtatccccgttatccgcctctgcgcaaacatcccaataataacggatgccgccctcaaattcctgttcagggataaaggaaagggaggaaatatccgtcctctctccgctgtcatataccagatcggtcatatcctccgtcctggataccctgattctggccgatttcagatgcctgccggtgctttcctccacctggaaggaaaaggacgggttttttacgcaaaagcccagcgggttcttcagatgattcacttttaaatttgtcagcttcatgtgttttttctcctattactgcttcatgcttgatggccgctgcctgcggcggggtgtttgatttgcttatacaggttattgtaatatgcagggagaaaatagtcattggctttttgactgtctttttatgacctttggggaattaatgaatatagccctgcagttctatgactcttttaaaccggatcagcgccaaggctgcggaaatgccggacacggaaaaaccgccgcacaggcaaaattttcccatacggcggcggtgcagtttctattatccaaacaaatcagcgtatgtcccggtgcggaccagggtcaataccagaacatttaattgtgtggtgggttttacggtcagtttggtttctctcatttcttcagatctgcgaacagttcatccaaatcggtgtagccctttaccgactgatctttcgcaatcctttccgcctccagcatcgcagcgatggtttccttgttggggcgttccgttttgattgcaaagggaattcctccctcccgcagcgactggcggacaaaaatattaaatgcagtcgccaaatatccatgcaagcatgactacttggctcgttgctcgcgggaataaaaatacaattacgcttcccttattccaaaccattctccgacaccccgttcccggaaaccgaatttccggaaacatcgtctccatgctcctccaggtatttttccaccgccggatcctccatgtcgtacacccgcttccactccttgctgtcatccaccttcaccgcctcagagcggttaagatagaggaagcgggaaagctggtagcagtcaatccatatttcgttgtccgattccttctgggattcgtcaaaaaccagttccagcccccaatggagatggacggttttaatgttgttcacattttctgttttggaatacccggtgtggcccatgtagccaatgatgtcgccggcagtcaccgcgctgccctcctccaggccttccgcgaacggataatcctggcgcaggtgggcgtaataataatagcgccttccgtcaaagctgcggatgccgattcgccagccgccgtattggttccagcccatcacctccacatatcctgattccacagccaccacaggggtgccaatctggcccatcatgtcgtgccccaggtgcggcctcttgtaaccatagcttctggaagagccgaaatcatcatagtcggtataggggaagcccttggcaatgggtgaataggccttcaggccatatttccgtttccataccagattcccggattcatcctgctcctgcagcaggaactcgcctaccataccgcccagcgcagcatcgtaggcttcgcggaaataatcatagttcttcagatccgccgtcgcttcttccagagtggtttccccgtttttaatcttttccgtcagggcatccatatccttcagtgcctgttttccaaactcgccgccgttcctggccgcagtataggccagcagggaaatccagtcaatgtgataatcctccctgtaggtatccacgtccgtctcataggcctgactgagggcttcacaggaaacattgaagtccacccacttaatatagtcttttcccgtttcttcctctgaattttcctccatcagcacagaatctgagttcacgctggcaggccttcctccggcctgtctgaccgcaagcagcagaaggataagcaccagctctattaaaattgcatgttttaattttccgcagcgtttcatggcggctccaaaggtcttttctatccaatatatgcaggaacaggtccgctaagtcctttaacctgcggctatgcctctggcattaactccggctccgccttcttctcacggcgccgccctgctctcacggcaccgccttcctctcatggctccgtctcacccttttgtcccggctttgtttccttccgatatttccagaagccgtaagatattatccatggcgaacgccagattttcttcactggacttacgcgcctccctgaacggaacgggcttcctcgttatgctgaacgcggcgctgacgccggaggtgtagatatccccggtgttttcatcaatgctccccgccactgccaccagcggaatccctttgcgttttgctctttgcgccacgcctcccaccaccttgcccatcaggctctggcagtccagccttccttctccggtaaaaataacgtctgccccctctatcctttcatcaaaccggacagtgtccagaaccacttcaatgccggaacgcagctgcgcctgcagaaaggccgctgcgccgcctcccatgccacccgccgctcctgcgcccggcagcccggaaacatccctgcccagatcccttgccagcacaccggacagatgccgcagccctgcatccagcctttttaccatggcttcatccgctcccttctgggggccgaaaatgcaggctgcgcccagcgggccatacatgggattatcaatatcgcacatggcggtaaaccggcattccttcaaggcgggatgaagtcccgacatatcgatgctgcaaagctccaaaaggttcccgcccacaggcagaaaaggctttccttccttattcaggaaacgcactcccaacgcggccgccatgccgcagccgccgtcatttgtcgcgctcccgcccaggccaagcacaaattccctgcagccctgttccagcgcatccgcaatcagcccgcccaccccataggtgctggccttttccgggttctccctgccctccgccagcggaaggccggcgcatgccgccatttcaatgacagctgttctttcttcattctccaggattccgtaaaaacccgccaccggatccaggaaggggccgggcacccgcaccgtccgttttctgccgcccacagcctgcaggaagcagtccaccgtgccctcccctccgtccgccaccgggatctgtatcacctcacaatccgggaatcggcgttttatgctgctgtccataacttcgcagaccctggtggatgatagcgtccctttgaaggaatccggaatcaaaaccactttttttatatccatacccactttcccatatgccggcgtcaatagagcttatcaaaaatattcgaacctgtcccatccatgacagttacaagtattttcttataaaaaccgccttctcaagctccttctccggctccttcccataagcctcaatactcaccctgccgtcgtatcccttctcttttaaaacggtgaaaaattccctgtacgcctcctgttccgctgtagggaagcttctccccgccggttctgcaaaatgcacatgtatgatatcctccgtcagcgcgccaagagtctcaaggctctccttttccatcataaaatgataataatccaccagcaggcggacggaagacctgtccgcttccttcatcagaagcgctccctcctccaggctgcatataatattgctttccctgcggttgagcggctcgatggcgatgcggattcccgcgggcagcgcaaaagcgtcaatgatgcggagcgcatctgccgtctggcagagagccctgtgataatcaaacccctccggcacatttttggcgccgctgctgccaaatacaattattttcgctcccagccggaccgccctgtccattgccccttttacatactcgctgattttgggcggatcagcttcctcccctgtcagccttatcgaagccgggaaaaaattattgcagcattcacagggaattcccgactcctgtatctgtgaaagaagctcctcaaatccagcctccgaaagctccattatctgcgccagcggaagctccatgtaatcataccccgccaggtacagcaaattcatatatctgcggccaatcggttcgctgctgtcccccagcatattcaggcagcatcccagtttcatagccttccccttcctgacggaacagtcagcatttataactgttccgtcccttcacagccatcgccgaaattaatcagcgtttcacctctatattttcctgttcctcataataacggagcaccgctgcgtgatcacattttccaagcccctcttcctggagttttttcatcatatcaagcaccctgtccgtcatgggcagttccatgccaacggccttggatgcattctgcgcattcgtcagatccttgatatgaagctcgatacggaagcccggatcaaaattacggtccagcatcatcggcgccttggcgtccataaccgtactgcctgccagcccgccgcggatagccttgtagacattctccggatttacgccggatttcgtggccagaaccagggcctccgacaatgcggcaatatttaccgccacaataatctgattggccagcttggtcatattcccgcttcccactggccctacaagaacgatagaggagcccatcttctccagaatcggctttaccctgtcaaacacctcctgctttccgccgcacataaaggaaagcgtggcatccaccgccttgggttctcctccgctcaccggtgcatccagcatttccccgccggccgccgccacctctttttccagctctatggaaacgttcggatcaatggagctcatatccacaaggatcgttcccggcttcatgccttccaggacgccgtccttcccttcaattacagtttttacatgaggggagttgggaagcatggtgaggatgatatcgctttctgccgccgtttccctgggcgtatcgtatgccctgccgccggaggcggctacatcagccaccgcatccttgttgatatcgcatatattcagctcataccctgccttcagcagatttttagccatgggttttcccatgattccaagaccgataaaacctattttcatttgcaaattccctccttgctctgcagccttccgccgcctgtcccgtaaatagtcccaatccggctatacttcctgttttcccgttgcctttctgattttcctatatatgctctttgcatccagcccataatattccagcagttcctcatgggaggacgcagactgcccgaatacatccatgacagcgacgctttccataggaatgccgcttcccctgagggcaaagctgaccagcatattcaacccgccgcgaatgctgcattcttcgcagactacaacgccctttttcccggccgacagggttcttaccgcctcctcattgagcggcttgatggtggggatgtggaccacgcttacgctgatcccctctttctctgccgctgcggccgctttcagcgcttcatgcgccataattccatgggtaaaaaccgtcacatccgtcccctcgcgcaaaaccacaggctcgccaatcctgtaggctacatcagtggggaaaatatcctccagatcatttctgcacagccggatgtagcaggggccttccagctgcgccgcagcctcaaccgcccggcgcacctcaagcccgtcgcatggcgtgaataccgtcatattgggaattgcgctcataattgccacatcgtctatggactggtgcgtcgcaccgtctccgaaatccgacataccggagctggatcctacgatcttaacattcagcttcgccgttgcaatgctctgcctgatctgatcatacgcccttcctgaggcgaaaacggcaaacgtgttggtaaacggcacctttcccgccaacgcaaggcctcccgcaaagcttgtcatattctgctccgcaatccccatttcaaaatatctgtccggaaatgcttcctcaaacatacagctcatggtggattttcccagatccgcttccagcaccacgatatccggattcttctttcccagctccaccagcatgctgccatattcttttctctgattatgtacccccattttacgcctccgttctgctgacacagcctaaagcctgcagcgcttcttcgtactgctcctgcgtaagcgttccattatggaaggctgcgaccccttctgcaaacggaattccctttccttttacggtatcggctataatgcagaccggtttttccctgatttcatccgctttgtcaaaagcatcggcaatctgtcccatatcatggccgtcaattaccataacctcaaatccgaaggaacgcatcttgtcctcaatactgccaatctggaaccgatccatggtctttccggttgcctgcagcccgtttctgtcaataatgacacacagattgtccagtttaaaattggaagccgccataaaagcctcccacagctgcccctccgcaagctcgccgtctcctaccgccacatagaccctggagtccagtccgtcaagcttaaggcctgccgccagtcccgccgccagggataccccctgtcccaaagagcctgtattggcttcaatgcccggaagctttctcatgtcaggatgtccctgcagacggcttcccagctttttcagcgtatggatataggtttccttgtcaaaataaccgcattccatcaaagcggcatactggacaatcgccgcatgccccttactaagcaggaaacggtctctttccttccagcccggctctgccggtttatgcctcattttataaaaatacaggaccgtaacaatatccgccagcgaacaggagcctcccagatgtcctgccttccccacaccgatcatcgttacaatgtctttcctgatttccctggcctgtatttccagttcctgctttttctcctgattaagcattgccggtcccctccttattccatgttctcaagcatttcccggactcttaagaaccctgtctcaccgctgttgtacacaggcaccctggtatcctttaaaaacggcgccagcgcggacatggacagctgcgccatgacgatgcagtccacctcctccgaaagcctgtcaattgcctccaccagtatctcgttgtgcctggcaatatttcctttggaatactcttcaaaggcctcgctgcataaaaccgttttccgctctatctgcattcccgcctccgccgccgcgatatccagaagcctttcggaggacggcaccgttgtggcaagcgtcgccagcaggccgatccgctttcccgtcctgacagccttctccatcatcggacggtcaatctgcgcaataggcgtatttacaagcggcctgccaagctccgccgcatagttgaatgtggaacatgccagaagaatcaaatccacgccggcttcctccagattatgcgcatactgggcaaatttaaaatagttaaccttggggataacgcctgcccccgccttaatgttatcccgctggatcgtatcgtcacacagatgcatgatttccacttcaggaatatattccctgatataaggctccatcgcctgaattgtaatatgggatgcgtggataatccccagtgtttttccgcttaaatccatgctcatattttaccccctttttcttccggcccttttgcaaaaggccggaagctgaagctgtctcaattggcagcctgttatatgtccttatggccggcatttccttatggccagtatttccttatgaccggcatttccttgcagctgaccttttcttacggccggcatttcccgcggccaaatgctttactcaattaccagataagagactgcatgcgccggcaggctgaattccaggctgagggctccgttaaccgcagccgtttcatcctcacacagcttctccaggccgtctcttgccttaattgcatcatactgctctccttccgggaacagcgggctgccctgtctcacccattccgcatacgggttggaatgctcggaatcaatgcggtaatgtctgattttcacctctttttcaccgattccatccaccttcaggctgattttctgatcctccgccttgtcacggtcgttgcagtggctgtaaataacaatctggatttccccgtttttccctcttacagcaaagcccgccacatccgtatcctcgccctcgccggtgtactggctgtgattttttacgccgatttcaggctccttcaggaattcaagcttctttgtgccatcgctttcaaaggaaagcttttcatttcccagagagccgtaaattttaaacatattgaatacagctttatcgattccctgtgtggtaaaggttctggttccttcaaaacacctttctcccgggaacatgaatgcccatgcaagaggccttacccggatgccgtactggctgctgagctgatcgattttttcataggtggaagcaacgtaggttgcataatactccgtatttctgaaaatcatgttggcattgtcatagatgccgcccgctgcccagccgtccgggtccgcctctgaaagcaccacctcgcagtcctggtagccgtactcctgaatgatatccagccccagcttcacctgatgcaccaggctttctacggaaggcacggccttgggcgcatgcatttcaaacgggaagccgccgcctttaacatggaaggtaatgaaatccagccgtgttcccttttcctgcgtacagaaattcgcaccatccctgcagtggttcaggaaaaagcggaaaaacttctgcgcatggccgcccgcaaaaataccggttaccgcagggcctgacagccttaattccggaagcacctcatgcactgcatgctccgtatagtcgtataacttgcagtattccgccgcagtcccgctccaatagaaaatatccggctcgttccaaagctcgaaataccagctctttacctcttccgctccgtatttttccaccaggtgggacgcaaccgccttaatgaaatcatgccatttatcataatccttcggagggcaggtccagcctacctctttatatcgtccgtatttttcccagttgtccgctgccggtctcagataattggtatccaccaaatccattggcataaagcccagctctataaagggtttgtttccggtactaagaaatgcgtctatgatatagtcataataggtaaaatcataaaccggctcccctttttcgttttcccaataaatattggtggaaccgaatttataagttccatggcagttgcccgtacagaacatgaaatgggtcctgaaataatagggggcatctcccagtgcagcaaattttttcaataaatccactccctcagggatataagtatagttgcactcgtcatagccaatgtaacgccagagatgttcctgtacccctatagaaacacctgcatccacctttacatttacttgtttgttcatccgcttttcctccgcttttttaatttatatttacccgggtatcaccagccagactgccaactatgctgaaaaccaaaggttcccttctctgcctggcaattaccgcaagggccaggttccccgctgcctgcagcaggaaatccgatttttaatcccctattccggtcactgtacgcctatctgtaaaataacatgccacaattaacacggtcctgtctctttcaggggaaggacattcttttttccatcatacagccaggcttataaatcagctgccgggatgaggctgttcctcccgttttttaagtgtatccctggttatcagcaccggctgcagaattattctcttatggaacttctgctcctcaacatcattgctttccatacggttatccacagcatccatcaatgaaaagcattctgcaatcatcatatttgcatccagagaataggttgttaacgctggagcaaactgccctgccaacggtatattatctacactgagcacggaaacttgatccggaacttcaattccttttgtcctcaacgcctgaattaatccaatcgccatccagtcatttgctgcaaatatcgccgtgtatttatgaaacatgaccagattagccacctgatctgcaagatcgtagcctcccctgaagttcattttgctttccagaattacattctcaatcccattttttcttgcccctctgataaaaccgttcttacggtaaagagctgaggcataagtaccaggcccggtaatatgtattaccttcttatgtccatagccactcaaaaccttagctgcattcataccgattttaaaatgatcgaaatatatctgtgcaaaatcatcatgattaggataattttcaaaagaaatgatatgggggtatattttttttattttctgcagattttcttcttcaaacttaccaatcataaggaccggtgaaatcatatcaccgttttccagcgtttccaaagtcaatggaatcatatttacgctattttttgccgaatagccagtcagctccataagcatcctgttataaaagggatcattaagtttgatgctgggagaacatataagatttatgtatttatttttaacaatgggtgtgacatatgtgcctttcccttcatatttgataagaagcccttcggatacgagctgattaattacttcccggatacgctgcctgccaaccataagcctccgttcgagttttctttccgattccaatttaatcaaccggtcggactgcagctgctttacttctctgcgcaggatgtccgcaatttctttattctcctgattcataattttacagcacctcatttctttgttttcggcaaaacctttggtaaatatctacaatcaggtaattttcatatttttgtatattttatacaatttatgcatttggtttaacccaaatcataatacaaaaatcagaattttccataaaacctcttttataatttgtccaaacttgtaatttacactgttttttaaggctatttattcatcatttttactaataatatatcactctattttgcttgtcaataatattaatcttttttgcttttttataatgtaccgtttctctttcttttcaaaaaaagccgcgcccccggtgatccatcgatcaccgggggcgcggcccccttttctatctcacttgcttaactcttaatattccggttcaatcaatccgtaggtattgccttttctcttatacactacgttcacctgctctgtttccgcattgaagaaaacaaagaaattatgtcccagaagttccatctggatacatgcgtcttcgggatacatcggcttaatgtcgaatttcttggttctgacaatctggatctcctcttcttccggataatccttatcaataaaagcctgctggaaattgccgcctgactgatgcttgtccgtaattttattcttatatttcttaagctgtctctcaattacctcttcaaccaggtcaatggatacatacatatcattgcttgtctgctccgacctgataatactgccttttaccgggattgtcacctcaatcttctgtctgtctttctcaacgctcagcgttacatgtacttccgtgtcctgggtgaagtacttttccagcttgccaatcttcgattccactgcgctgcgaagcccctgtgttatttcgatgttctttccgctgataatgaatttcatgccgatcatcccttctgtttcatattaggaacaaagaccatattgcctgtccacatcctgcggcatatctttttgtccttatttggattataacatatccccacaccggcatgcaatgttttcagaattttaactgaaaatttataattgtttctgtcaatgtgaaatgacataactttgtaattattttgtaaaattcgtggaacttgccaaaacacccgttccattttacgttcttacgaacagcactgaaatattttctcaacctgtggataatgtgtataagttcgtgtataactccataatccccaaaaataccgctttttctgtgtggataactttgtggttaaaaaactcttatttctacatacttcgacaaattttgtgcagaatctacaatccgggtaaattcagtgccttttcagataattttgaaagtgtcagacaataatatatttttaactgatttttgaaaaaaatctgtctcctgccatccccctgcaggcggcgcgtcagactgcttttcatgtcctgtgatgtatcagttttttgctttcccaggacttgcccttaaagtaaatcagacctgtgacagccggcagaatcggcgaaaccgtctgccctattgtccagcaaggcattcctgcaaacgtatttattttaagccctacaccggatgctgcagcgacggatacaccaaagtaattcaacattgcagccaaatattccaaacggttactgtctgcccctgctgttcctccgcacctttatattgggcaattaaaactgttccgcccattgtaacgccgatgcagacggagttaatgacaaaactcaacatggaagcattactgattgccacaagccccgtttcacgtgctatattcctcacaacaagcatatccatattcacaatactgtaaaaggactggagcaggctggctaacaggaggggaagcgcaaacctgatgagcttctttggtacgcttccggagcatttttttcctgacaggcaaacatcatcacccactctttctgcataacaaaaaggatatgctcctaagaacatatcctctgttacttttcattattatttatttctcagggaagaactcttcttactgccacaggagttctgtaatccgcctcagaaatcttgattccggtgcttgccgtgctggcatgtacgatctgtccgtcgccgatgtagattcccacatggccggtatagcatacgatatctccgggctgtgcattttccagtccgcctacatccgtgcctacatttctgtctgcagatgaggaatgaggaagggaaacaccaaagttcttatatacgctcattacaaaaccggagcagtccgcaccgtttgtaaggcttgtcccgccatatacataagggttgccgacaaactgcactgcgaaatccgcaactgattcaccgtgtgatgaaacggctgctgctgcagaggttgtctctgctgccggagcggcttctgcggaagcttcagaagaagtttctgttgctgcagactccgttgctgtttccgaaggtgcctgggaagcggtttccgttgttgtctcagtgcttgtccctgttgtagtttctgttgttgtctcactgcttgtttcggtcgtggtctcagtggttgtttccgttgaagtctctgtagttgtttcagaagaagattccgttgttgtctcagatgaggtttctgttgttgcctcagaggaagcttccgtcttagtctcagaagaagcttctgatgaagattcggtctgagcagaggattcggtttccttctttgactcttcttcggaagaggtttcggtctgggattcagattccctgctttcttccttttccggttcggattctttttcctggctattattaactgcctgtgaggattgctcctgttcaggtgtctgggttgtctctgatttggcagtctgtgtttccttcaggtctacaggttcaacaattgtcttcgactgtgcaagagcttctccctgcacggtagcctgtccgctcagaaccgcatcctcgccgattgtcagaaccacgtctgacacagatgcttcggcttcaggagcttccaccgcatccagtacgcttgccacgccaataccattggtaatcgccgcctctgtctgctgttcctggatatgggaatcaacctgtgcgtcaatggatgattctcctgctcctgtcattccggtttcgatatccacagatgttacctctgaggattcctgtgcggtctggacagtctgtgcagccttttcgctctggtctgcttcttcctgtacacttgtgagggaactgccttcatccagcgtcaggccgatgcctgctgccggaagttcataagatacaccggttgcacttgcctgcatagcagctgtaccaaatattactgcggaagcagtgattgcacatgttacagctttcacgcgtgtatatttcatgagttcctccaaaaaatcatttgaactgttacatttgttacgaaattattacatctgttgttaactataccaccgccgccattttttgtcaacctttacacaaaaagcgattctaaagagaaaaagcctgcgaaaccgcataaaatcaaggaaaggaaggcactcggccttcctttccaaattgtgaacattttttgaattttacagattttatattacatactggcaataattaacaataaaagttgttacgtaatatttaatatttacattggatgaacatccgatgcttcttgaatacaagagctattcaagaagatacgccgtactgaacaattacagtaactgtgaggggtactgaacagttaccaattacaatatttatattgcaacattcctgcaggaaatattactgcaggaaatattcctgtacgccctccaccgcattggccccgtccgccacggcggttacaatctggcgcagcttcttggtacggatatcgcctgcggcaaatacgccgggcatactggttgcgcagtcctcacccgcgataaggtagcctttttcatctgatgcaatgttggagataaagctttcggaattgggtttaataccaactgcgataaaaacgccctgaagaggaagttcccgccgctctccgctcggtttatgcagcatggtaagagagcttacctggccgtcgccgttgatgctttccactacactgtcccagcaaacctccacattgggcagcgccagcatggtattctgcagcgactgtgccgccctgaggctgtccctgcggtgaatcaaatataccttttcacaggctctggccaggaaaatggcatcctcaaccgccacgtctccgccgcctatcaccgctaccgtcttaccccggaaaaaagcgccgtcacaggtggcgcagtaggaaacgcccattccgctcagttcctcttccccgggcacgcccagatggctgtgggaagcgccggaggctatgataaccgccctggcctcaaaatccccttccgctgttttcaccagcttgcaatcctcggaatcctccacgccaagcacatccgcttccatgaattccgcctgcattttttccgcatgctccctgaacttcatccccatgtcaaaaccgttgattccaggcagccccagataattgtccacctcataggtgttgagcacctgacctccgctcatgggatttttctctattaccaacgtggaaaatccggctcttcttccgtataccgcagcactcagccccgcaggaccggaaccgataattatcaaatcatgcataatcactacccctttaccattctttattgtaagcttatccagccgttgtttccattataccggtttcggccgcagctttcaaccttcctcaggatatgttacaataggaagacaccaagttcataaaaggagaaccctatgagaaagaaagcattaattaccggagcctcccgcgggatcggggaagctatagccaaagagctggccaggcagggctttgagcttacgctgacctgcctgaattcactggatcagttgaaggagcttgccggaggcctggaaaaaaaatacggcgtttcctgtcacattttccagggcgatatgggcgatccggaggctgtggatcggttgtttgacggactgaaccgcctggatgtactgattaataatgcgggcatctctcacatcggacttctttccgatatgtccgtttcccagtggagacgtgttatgtcaaccaatcttgacagctgtttttatacctgccgaagggcaattccgctgatggtgcacgccaagcagggacgaatcatcaatatttcatcggtatgggggcaggcgggcgcttccatggaagccgcctattccgcttcaaagggtggggtcaacagtcttacaaaggcgctggcaaaagaacttgctcccagcaatatccaggtcaatgccattgcctgcggggtaattgataccgatatgaaccgctgctttgcccctgaagaaatggcctctctcatcgaagaaattccggcagacagaatcggaaggccggaggaggtggccgccctggcgggccagcttataacggcgccagcttatatgaccgggcaaatcatcaccattgacgggggatggatctgaaagacagcgcccctttcaggagcgctgttccatttctcttttcttttttaatatggcggcattttcctccaccttttttctgctcaatggataggcaaaggcaagaatggctgccacgcccaggaaacagactgcggggatcaggttgactgtggcataaatgccttccaccaccctggcgttctgcaccgtagccagctcatcgtagccgatggcctgcagcgcagcgccgcccagccctccggccagcgcctgtcctattttacgggcaaaggaatagacggaatacaccgtaccgtcatccctgcttccggtccttacctcatgatcatcaatcacatccgtaatattcgcccaaatcaccatattgaacaggttcacccccagaaatccgatgacagagagaatcatatacagccatgcgctggtaatgtgcatgaaatacagaatcaggtaggccacgccggaaaaacaggtggccgccgcagacacttcttttttcccgaagcgtttggaaagggggacggtaacgcctgcaatggccagcgacaccacggtggaaaccaggctgaacgcggaaagcactttggtattccggaaataatccagatacagatactggttcatggactggattaaaagctggctcagcagaaggccgatggctgccccgataatcgccagaagggccctgctggaaaaaacagtacggaaggttcttgccagcgttgcattctcccggtttcccatcctgtccatacgcacccgctccgtagtgcagcgatagcagataaaatagcagacaatggcaagcagggaaaacaggcctgccactgctgtaaaacgcggaccgcttacgatctgatttcccgcagcgtccgtcgtatagataagaagaggcgcacccaccccgatgaccaggcctgccagcgtcgcgccgataccgcggaatgtggacagcgaggttcgctgatccggatctgaggtgacagcggacgccatggagccgtagggaatgtttatcgacgtataaaaaatgcttccccacaaaagataggttacgtacatataaatcatttttaccggcatggaggcgcctgcaaggccggactggtacataaggaagcttgccagcgccaccggcgcgctcatcctgcgcagccagggcttaaatttcccatcccggccggtacggctcatatccacaatgcggcccatggtgatatccgtcaccgcatccacgcatcttgccaccagaaaaagggtacccacggcaaggccgctgattcccaatacctttgtataaaataccatgagaaaagagctggcaaatataaacgtaaaatcgtttccaaagtctccgaacatgtagcctattttatcccgcatgccgaagggccttatattcccggcattttgttctgttttatcattcatcgttttttccattccttttctaacgtttcccagattcccatgagatatacggcgcccagcgctctgtcataaaggccatagccgggtttcccggtttcaccccagatcattcttccgtgatccggcctcatatagccctcaaatccggtttcataataggccttcatgatttccaccatatccagggagccgcagaaggatggatgggcgctttcctcaaaggaaccgtcctccagtattttgacattcctcatatgggcaaaatgtattcttcccatctttccgtatttgcgaaccagatgcgggatatcgttgcaggcggcgcagcccaggctgccgctgcaaaggctgaggccatggtggggatcatcataaagcgaaaggaaacggtcaatggcagcctcgtccgtgataattctgggaattccgaaaataggccacggcggatcatccggatgaaggcccatattcacattgcattctatggcgaccggaatgatttcctggataaaatacttcaaattttcccaaaggccttcaatgccctgaagctgatattcccggatcagctcttcgatctcttccggaaaataggaagcatcccagccgggcagggacatctttgccggatccatcctgtccacatcctctttatagtaaacaagggcattggagccgtccggcagcggctgatccaggcgggatctcgtccagtcaaaaaccggcatgaaattatagcagatgcatcggattccctctgctgccagcctgcggatattttccttataattctctatatattcctggtattttccccggcgcaatttgatgtcctcatgcaccggaacgctttcaatcacttccagcgcaaggccggaacggctgactttttctttcagttccctgatggcctcaacgggccagactttacctacaggaatgttatatatggctgatacgatgccggtgacgcctgggatctgtctgatttgccccagggttaccggatcgttatccccataccatcggaaggtcattttcatggatcggctcctttcattagggagggttaaattaagatgggcatgattatggcagggaaagattacagggccggggcaccgcgccgggagccggcggaatggacggctgtgggtgcggtgcctcggattgtatcatttgctattgattttagttttgccagggatttttgattttatgaatgaaaattgagaaattaagcagatcagcgaagacggtgcagaacatattttaattcaggctatcgcataatattttttacaaaccggagtttttcatacacagaaaagtaaccggcttcccaaaagaactggccttctgttctccataaaccttaaatccggcccgttcataggtctttattgcgcgttgattggaatccaagacacgcaataccaccgggccgtcaggaaaacagaaatgacggcggccatgggcaattgcctgttttacgaattccagcccctttccttttccggtttcctcagggcataagccaaggccgatttccatgaccttttcttcattttcttcatggaaggaaaattcatagaagccgagcaatcggtcgttttcatcaattactgcgaaccagtaaggaaggttttccatgacttcctccaggcattcatcgtaatgcgcccttggaatattgtaaaattcatagggctccgggtaactccagtccagatagcggacggcatattcttctgtcattggcacaatcatttttttctcctgtctgcccgttccattaaccgtttttagcgccggttgaagtggaaaggcggtatgatttgtggtacgctgaaagcagcgtaattacttcaggggggatacggttctgtatggacgagaaaattattgccgatatcaaagcaggctttggcatggctatatctaatattaccacagttaacggaggctggctgaaccaattatggagggcgtcagccggagaccgtgagcttctggtaaaaaaatacagcagggaacggttcagcagggagaaattaaacaggattgagtccgcgctgcaacggcaggcaatgctggaggcgtacggcgtggcctgcccccatgtataccggtgtgggcagaaaatcatacggttccttgacgacggtacagcttatatggtgatgtctttttgccaggggaaaaacgagaatgcgcagacaatcaacaccgcgcagatgaaaagcctcggaagcgcctgcgggtacctgcataagtctttttccaggctcaccgggaacgttgaaaagagctttccggcgttcggcggttataccaaggattcgctatgccagaccctgcgcaggcaaaccaggcagcttacctgtgatatgccggcggcctaccgcagggcgctgctttcgtgcgaagccattgtaaagcagcttccgccggatttttttgacaggctgcccagagggattgcacatgaggattttacgccggacaatcttttgtttcatgagacaggcgtggaggcggtcattgattttgaccggaactgctacagctatccctggcatgatgtgggcagggcgatcctgtccttcgctttggaggatgggcagctgaattatgagaaaatccgtgcctttgtggatggatatgcactgcatatgcccctttccctggcagacgtcggggatgccctgcgcctttcctggtgcattgaggttccgtggtggatacagcctgactgctttaccccatccctgaccggaaaggcagtggatttcagggagcagatattatggcttaccacccattgggaggagctttcttttcctgctaatgcggtgtaaacgctttcctttccaccagatgcagagagcgttgggcctcttttccaaaaatgtcgtctctgaccgcatatccctcaaggacccgcacggcctccggtacgggaaaggcggaaaggcagagcagcaccttccatacaatgatctcactgccgctgtgggaatgcaggaggcgaagaatccgttccgcattttccccgtccgccagggccggatggtaaaaagccataaagcccgccgcgtccagcgcttccgatatctgctgttcactgcctgtattaaacagctgcagaaggagggggaaaaccgccgtatccattcttgcaagggaacgggcaatcaggtcgcggggaaggggaaaggattttttagcggataccttatccggcagggccttatactggttctttcctatccgtcccagccagggaagcattttttccgcggtttcttccgtgcccttttccagagtttcacaaatggccagtcttgtatacaggcacttttcctgcgccagctgttccagcagcaggacggcggcagacttacttttcggatccatacagcgggcggcggcggcccgacggcagggatccgggctgcgcagctcctccataagctgctcccacggcagagacgcacaggcggcaatttcctccggtgaagccattcctctgtttttcaattgggaccgtgtacttttcatgtgctgttctcctttggcttaccgtcgattttcaggaagggatggaacccacatttttatggtagattacggcaaaaatcacagccgctgcaattgcagtgaggaactcggctaccggaaaagcggtccagatgcccgtgaccccggcgatttggatgcccagccaggcggcgggcacgatcagggccagataccgcagcagggaaataaggaaggaggcaaagccctttcccaaagcctcaagcgcgccggaacaaatcacgctcacaccggataccacaaagcccaggctgataatccgcaaagcggcagagccttcccgtacggtaacaacatccgccgtaaacagcttcattatgatacccggggccaggaggaacagcagcattcccgccgccatgatcaccagaatcatcacgctgcatatctgtataatccgtctcatccgcttcttttccccggcaccataattatagctgagtatgggacgcatcccctggacaattccgttggcaggcagataaataaaggactggagcttaaaataaacgcccagaatcaaaatatataccggggaaaaagcagccgcaaaaccgttcagtacggttatcagcagtgacggaagccccatggtcagggagcagggcacgcctacggtatacagcttaccgcagatttcacccgtaagcttcatattccgccgtcccagggacagtcccatatccttgcagaaataccagatcagatacaaaatcagggttaccacctggccgataaccgtagcaatggccgccccctttacctccagacgcgggatgggcccaagcccgaaaataaaaaccggatccagaatgatattggtaatgcagcctgccgccatacaaaccatggggaccagcatgttccccaccgcctgatatattttttcaaaggcaatctgaacggtaatcaccatggaaaagctgaggacaatataagcatattccattccccagtccaggattctagcatctgaagtaaacagaggcagaaaatacggaatgcacaaaaatccgcccacagacaaaagcgcgccgtgcagcaggctgagaagcagcccctgtgccgccgacctgtcagcgttctccttctctcccgcccccagaaaaaaagccaccgccgcattgatgcccacgccgaacccgacgctgatggatactaccagcgtctgaagcggataaacaagagaaaccgccgtcagcgcatcctccccgattctggccacaaacatactgtcaataatattataaagggaattgatcagcatggacagcatcatcggcagggacatggacaataccaacggaaaaataggttttgttttcataaaatcctgattcattaattaacatactccttccgcagccgcatcttttttggccgcatctgtcttttatcatttatttccgcatgcagcgaaccaggcgccatgcctgcatgggcatttagcggctgccgcgagggccggatgccccgttgcctgcggcgggatatttgcctatcctccggcagggctgccgcaaatccgtcaggactgcgccgcagaaaaaaagaccataaatctcactgtttggaatcagaaacaggaaaatttatagtctcttaccggacaccttatcttatcagaaaaaatctcccaccgcaatgggttaatccataaataccctataaccatggcgtgaactgttacaacaccgcactttatccggccggcaggagaatcttaacctctgaccgctgtttttcagccgttatacgcaaagcctccgttatgggtttccttggcgctgtacagcgcagtatccgcagctttggccagcgccgcataggaatccccccttttggcaaccaccgctcctgctgaaatcgtaatagaaggcatattccgcctctttgcctctttggcaatggaatggttaatatccccgataattcctctggcaaccgtataatcagcggtattggacacaaaaattgcaaattcatcgccatgcagacgggaagcaagatcgacggtacggatacggccgataatcatctgggctgtgagcttaatcacctcatcccccatactatggccataccgatcattgatatgcttaaaatgatcaccgtcaatcataatcaaaattcctcgttcctcatcctccatctgctccagacagctctccatctgggaacggaaggatttgaaattcatgaggcccgtaaggtcatcgatagccgccgccttctgcgcggcgttcaaagcaagctccaggcgtttctgtgtctgccccagttcaatatatgcgctcttcagttcacggttcttcatttccctgccgatccggctgaatacataaatcagcagcagctccagcaggagaaggggaacaagccagtatcccagcgtagacgtcagcatggacaacaccggaaccagcaccaggaaatggtaatcccccgcccccagcagcagtccgtaatacctgcctccgttaagcggaacacagaccgtctccgattccgccccggccagcctgtcgaattcgggctgaaagccctgacggaagctgcagaagacctccgccgccctgagctgctcctccgctttggaatactgttccccatcggccggatccgctgcctcaagctccgccctggccgcctccaccgcgccgctgaccgcgtccatggacgctaacaggctgcctcccaggtaatcctcctttgtgctgccgattaccgtcccgtttttatcataaataagtatctcttccttcttgtattcctccatggaggataccagacgctgaatgtcacccatcttaatatcatatgcaaaaacagtctcgccgtccggctgaagctgagacagcgtagtcagtatgtaatgattggcatagctcatatacggcggcgtaaatacgatttcacctgcgcctgccgccgcgtccttgtaccacggccgctccgtagccacatatcctgtctcctcatactgggaatacggcgtatcccagctgtaaagataacgtccctgataatacatatacaatccgtcaaaggtatccccttcaatttccagcatagtggaatcaatccccttcaggaaatcccagatactgtccgggtcagggctgctcttaatctcattgcgcatcatctccacaaacagccggaaagaatgcctgtaattctccataaccgattcaaactgtgcagccgtgtcctccgcccgctgctgcatccgcctatttataacagccgcttccctcacgccgataataataaccgcagccagattcactgccagaaaaacagcgacggcgccgtacagtttcctgccccggcttttctttagttgttccatgtaaatccccctcaagcagcctgctattcattacatgcttctatatttttaataataagtctgcatttatttattctagcacgtttatttgtataagtctatatcgtttaatgttttcccggttttcctgccgcccgtctgtattccttcggcgtcatgccgaattccttccggaacagcttattaaaataagaaatattatggaatccgttttccaacgccgcctccatcaccggctgatctgactgtgccagcgcagctgcagcccgtgacagcctgtaatgattgatatactccacacaggtcatccccacaaaccgtttgaaaaagctcataaaatgtgcctggctgaaatggcacacctccgccagctcttcaatggtcagcgtttccgtatagtgctcctggatgaatcccaacacagccttaagcttccgctccagctccgaatcactggccgagctttcattcttcaccacatatccatactgatacagaagccggaaaaaccggaacagctgctccttcataaaaagctcgatcccctcccgccttctcacttccccgccagcctcctggcagccagcaaaacgcgtataattcttatcctccaggcatgtcagcatctcctttatacacccaagcagcgcctcatgccccggctccccctctttaaccacgggaacgaaccggtactttcccttttgaagcggactgatatacttaatcgtacacgcgtccggcgtctgatatcccagcatatccagatgaaaaaccagactttctgaaatcatctcctcccccctgagcgcatgcgctgaatgcagcgtatgcggggaaatcaacaaaatatccccctttaccacccgataggtctcaaaatttatatcataatcaatctccccgtccgcgatccacgccacctccgcctcatcatgccaatgcagagacaaatcctgataagagaacggcacaaaacaccgataccgctgaatcggcatcaacacatccccatgagaagccttttccttaaaatcagtaattcccatatccttcctcccacgccatcctttcttttccctcccattataatctccccctcttcccccagtcaacgcccatgagacaccattccacgcctgcaccataaagcaccatttcccgcttccccggctgcagtagctgaattccggtaaagcttctttatgaacagtcagttttgataccggagtgcgggcctccttatgatatcacgagtatgaaaaagaattttggttccgaatatcaaaaaaaggttgccgccttcacgatttatcaatcgttaatgcgacaaccctcttgactcgatataaatattctaatggtcggaccagaaaacgtggtacaatggacgatagaatacttcttatttctcttatgctgcgcagacgttaactgctctcagttttctgctgtctctcgggtcagattccatatcgaaggtaaccttctgtccttcgttaaggctcttgtagccttcggaaacgatggaagaatagtgaacgaacacatcctcaccgtttgcgtcatttgtgataaatccatatcctttttctgcgttgaaccattttactgtaccgttattcattttcagtacctccattataatatttataccaattcaaaccagccgaagccttctgtcccgcattatgcgtttccaaaaactattttactgttaaaaaaactgacccatacagaaagtcattaagaaaaaaggaatgactcacagtacaggccagatctaaattcaaattgattacttagtcatactaacacgtatataaaaatatgtcaaacacttttttaaattttgatatatttttgtgtttactttattttacaaaaaaatatgccgtccgacaaattcccgtttcttccacaggtacatccggacctgccggcaaggcctggtaccatctgcctatccttcatctgaccgtcagccttctttatcctgtgtaaatactgcctcaaccaccgacttcctggcgctttccaccgtgacattgaacacaacggccagctcggaaatcagcatcttttccgctctctgcagatccttttcatcagaacagttcagctttttcccgccctgtttctttttttcctgctccagcagtatggccttcatcagttccagatactggctgacttcacaggatttcagaatctgcctgtttttcttttcccgttccttgttgttcgtatcatattccgcatcgatcccggaaagcttttccagatagcttctggcttctgccttggagataacaggtctcatatatactttgtcgttgttaatcttgacgtatatcatgctgctgtcatcccagacagacttcattgtgtaatactcctcctgtcctttgacaaaatcgggttttccaatggaaactatcctgtacacaccgccgttttcatgcaccactacatcatttaccttatacattttacaccttttcctttacaactgaaaaagctgcaacgggaacacaggcaggttaccgatgcagcagttatatagttattatatcacactttcacagaaaaagcactctttctttattttccaaattccgttaataattccgccaatatttcagtttttattgctatacagtctcgtcccgcacagcatctgctatggtttctttccgcatgctcagaaacgccagcagataggctgcgcccaccgaagccattacaagccctgcattcagaaggattttgccgtatggcagaacaggaaggcagctcttccaggataaatccgtcaccccaagcaggtaaataataataaccaaaagtaccggcaggccggtgagtacgggagcggccgctgtccgaagcccttccagaagcagcattttccttaactgcgcttcgtccattcccgcggaacgcaggacggcaaattcccgccttcgctgctgcagggatacgctcgccgcggaaagggcattgaaaatccctatcagggaaagaagcgcccctgtcaggtttaccacagcctccatcgcccttcctgacacctcgttttcctgccgctcttcctccctgcttcggattgtaaaatcctcttccgccagatagcggctgctgatttcccttattttttccgtaaccgcaatgtccttttccacagaggtaagccccacgccgcagatttgataatagctttccgctgtctccgggcggaacccggccacgatttcccgataggtttctatgggcacgtaaagctggatgctgtagtccgaattatattcatccagcacaggccttttatccgcccgatccccaatctccacctggaagctgtaatccgtttcgtccgaatcacgcagcttttcttccaaagtcagcacatctcccgcctccagggaaagcatcctgtactcttcctgctctttttccgaattattggcaatcccgggatagcgtgatacgttgcccaccagaatggctctgggaacctccgtgttattatatgcctccggatcactccccagcgcacggcagtagtcgtcaaaaaaggaagcctccagccccaggatatccgcccgtatccggtatctgccatctctttccagaacgctgtaatgatccggatccacgtcggcgaaaccgccgtttgccgcaaattcttccgtttcctgggacggctccgcccagtaggacactctggtgcggtaaaaccaggttccctcctcaagccccggcagggaaaaaatctcttgaagcatttccggatccggctccgaagccatctgccagcgcattaaaatattgtaatgcctggccgccgcattgcgttcggtcaccagattattcagcgtaagcagacagaaaaatcccgataccagtacaaagcacatggtcagcgccgccagccctgcacggaaggagcgccggttcgctttcctggaggcttgggccatcacaccttccacgccgaacagccccagacgggcgcggcttttgcggcgcttcagccagcgcttcttccctcccgccgcatcctcctgcatccgtatggcatccaccggtgaaagctcagccatctttttcgcaggcagggaagcggataccagtacggtaagaaaggaaacaaacgccgcggtcagggcaattccccaggaaaaacgaagcgtgaacggaaaataaataaggtctcccagaattccggtataaatgcgtaccatgagggctgtaaaaagctgccccaggccgattcccgcagcaatgggaagcagtgacaccccgatcccttccagcagaacggacgcccggatctgtcccggcgtcgcccctacggaccggaacatgccaagctgcctgattcttgatctggcggacatggcgaaggcgctgtatataatgagcacaaaggcggccgccgccagcagtacaagcgtggcataaaagaaaagattcgcgtaatttgacaaataccccggtgaaaaattctccatgggcggaaatacgccgcccaacgccagaagcctgctgtgatagcggaaatggttttcataatttccatattcatttttctcaaatcccagctgttccatcagaggcggcattaccttataggtatcccggatatttttcatggtaacataaaccaccagttcatccgtatcgttaagcgcttcgtgttccaggaagcccatggcataatagcccggcgtggtggtgggcgtggtcatatccagctttcccacaacggtaagcgtcactttttcctccggcaggaactgttctccttccatccttgccccggcatcccacagttctccgcctgccatgcggtgcccctctgtcagcgtgaagctgtctcccagccggaagccgggattattgtcaaaaaaagatttggatacgacgatctcaccgggcttttccggcgccctgccctccgtgattgcgtttttttctcccatcagtgaccagtagttctcatccgcatcccggaggagcaggtagggaagccggctttcctccggcagctgtacagacatgaatggccctttaatcattatcttatcgatttgcagattattctcaataatctccagcccatctttggtaagctgcccgcccacctccgcatgccagccgccgctttcatatcgctcaatgtcagcctgccaggcgatgttgttataaaatatactgcagagggaaaacagcagggtggatgcaatgagaactgccgccatggatgcaaaggtggtctttttgttgtttttcaggttccggaatgtgtattgcagaaggaccttcataatgcgtttcccccttccgcagacctgccgggagcatttttccgatcggagacggcttttccatcagggatatttttgctatcggaacagcttttcgggccggggctattcttcccctgggatacaatttttccgtcttcaatcaggataatccgatccgcctccagcgcgattttctcatcgtgggtaatcaggaccaccgtctgatgatagcgtttgttggacagcttcagaagcgccatgatttctcccgaattcttccggtcaaggtttccggtaggttcatccgccagaagcacggcgggccggtaaatcaacgccctgccgatggcggcgcgctgctgctggccgccggacagctgcgcgggcagatggtggaggcggtcggtaagccccagcgtatccgcaagctcacggaagctttcctcatccggcttctgcccgtcaagcagtaccggcagcaaaatattctgccgcacatccagggttggtatcaggttgtaaaactggtaaatcaatcccaccttacgcctcctgaacactgaaagctgtttttccgacaaagtggaaatatccgtatcttctattttaatcgttcctgaggtagggcggtccacaccgcccagcatgtgaagaagcgtggacttaccggagccggacgctcccaccaccgccacaaactctcccttctccaccgccagatccacaccatccagcgctgttaccgttgtctgtcccattttataggttttcgtcacattttcacactgcagaatgttcataatctcctccttttcgcagataactgtcctttttttcctgtctgcttccgcattgtaaaggagctgtgtgacaatccggtgacaaatccgtattttcctgccgggaaccgcaaaacgaataggaatgcatcatgttcttattttacaaatcccgggcggggtttccaccgtcgctgtaaaaatcaatgacaaatctggcgccgccgtttttcctgttttccgcacggatttccccgttctggctttcaatcagggattttgccatagacagccccacgcccacgttttcccggccagacttacgcccctggtaaaaacgttcaaagatccttttgcactcttccggactaaatcccggcccttcatcctctatttcaatgcgggtataaataaaattctgctgtgcacggataaaaatgcatcctccctccggcgaatgctcgctgcagtttttcaggatattagccagggcttccgccgtccagcccatatcgcaggaaagctgcagcccctctgcgccttccatgagtattttctgtttcctatgatccgccagagaacgcaccgattctgccgcactggtcaaaagctcctgcaaatccaccgtttttttctcaagcacaagcacgcccgcgtccagccgcgacagggtgagcagggcggaaaccagtcccctgatatgctctgtctgttgttccatcctctcaagcagctgtcttccttcttccctctccacctgctcctccaaaagctcctgaagcagggaaatgctggtgagcggcgttttcagctgatgggaaatatccgtcaggttttccgaaagtttctgtctgccttctgccgcttcctccctgctttcccgcagttttatcacggtcttataaatctcatcctgcagacaggaatattcatcctctgcggaactgattcccatatcgtattttccgcggttgattcgtgccaggtaaccggaaagttctccgacccgctgctctctcctctttttatcccaccagtaacagaaaaaaccggcagcgccaagcaggaggaagcaaaaagaaaggcggacggccaggccggcaaaatcatgaaatgcaaacaggccggcttcatatccataacgtttcagaagtccggctcccgccgcttcctgttccggcagcccgcttttaagggcctgcatcatttttcctgcgctttcaggcgctgccgacatcagcagagacgccctggtataaaaagcggcctcactccgccggatcgcccaaaggcagattacggagcaggccagcatacaaccgcccatccacacaatcagggcggaaattcccgcacttttcctattcattttcatccctcctgcttatcgcaggcttgcctgcggtactgcgccagtcagtcgtttgaaagggactttcaaacctgtcctccgctttatagccaatccctctcaccgtccgtatgattcgctgcggatccccacccagcttttcccggagccttttgatcagcactgtaagcgtgttgctgttgacaaaatctccgtcgatatcccacagacgttccagcaggagggtgcgcgtcagcgtcctgtttttattctccagcaatatttccagaagacggtactcccctgcggtaagcaccgtttccttcccgcccacgctcacctgggttctttttttatccagaaccacgtccccgcatatcagaagctgtgtttcctcccggccgggctcttcttccttttccccggctctgcgcagggcggcccggattctggaaagcaggatgcccagtttaaacggctttgtcacataatcatccgccccggcatccagtccttttatgatatccgcctcatcatccctggcagtcagtataatgacgggcgggccgcctgcttccctgaaggccttcagaagcgtcagcccttcgccgtctggaagccccaaatcaagcaggacgagatccaccggattttggataaagcgttttgcctcctccaggcttcctgcggcgcttacctcataaccgtttctgccaagcgcagaacgcagcgcaaataatatggtttcatcatcttccactatgagtatccggctcaattcctgttccatcctttttatcagtttatctccgcgcgcggctccgcttctgccggctggccggatgcttcagcccccttcagcaggcaggcctgctcagcctcctcccagcgtctccaccgcctgttcgaactccggcaaatggtccgtcagcatttcatcaccaatataataagcaaagattacctggtttccttttctggcaaaaagataatgcagccccctgtcatggatgaccagttcgtcaaaatagctgctgtccaccttttccggcacccagcctttataccagtgcatatagtatcttcccagctcctttaaaaaggtgctggccagctttggcgtaagcgtctgatagtactccagcttcagcgtgctttccctgctgtttcccccttccttccatttcccgtactgcatcacctccgcctgcacgggcgcaaggagggaacctgttacgagggaatagctgtcctgattctttcccctataagtatatacccggtattccagttcttcattctgctggattttattcaatggaatgagggcgggcgacagcgttttccaggcaggatgtttttttaaaaaggatgctgtccggaaatccccttccttccagccgtcttcttcatatgccgcggcatttcccgtcagcaccatttttttccggctcaccgccgcattgattccgcccaacagcccgaataccgtacagactgcaaaaaacgtcagcataacccggtataatatgtcggctgcttttgcccgtcctgccgtaatttccccggtttctttgttatcctgggcttttatttccccgccgccccgcagttctttcttaaacctgatttccatttcccgcagcagccgctgcaccagcctggcctcctgccagctgccagcctgtgacaggccgcacaatcccatccccagaaaaaccacccagcagtatcccttcaccgccagtaaaagcattccataccccatcagataactggaagccaccagccagatcaaccagaaaataaagggggtaaaaagtccccaggcgcttcccttcagcttcctcaaaagcttctcataaatactttgccccttcagctcctgaatccgttcgcactgccccctgctgccgcgcagcacaagaaccatccgcctcagctgcgttacatattcccagccgaattttttatattctccgccctgctccgccggtcccttcatatcatccgggtccatggggacaagcatatacgcagcttcctccggctccgcttttataaaaacagcccattttcttccaagagactgaagaaacagcccctctgccgccttttcctcaagccatccttcggccttttccggcaggtaaaaatcttccggtaatctgaaacgaaccttttgctttttatccatttttacctcctgcacatcacaggcctgcccgcgatactgcattattccgcagttttaacagaaccttcaaacctgtctactgccttctgtgaccctttttattatactctcttacctgttatcggaacaagccggagggaatatccttttcttatttttttattaaatcccaaaaaggccgcctttttaccggaaaaaaaggaaccgtccccaggctgaatccggcccggaacggttccctgttctgttatactgcaacgtattatgaaagtgctgattcggctgtacggttggaaaaattattcagctgcgctgctgctttccgtttcttcagcagaagcgttccccacagcagtttcagttgctgcttccgtacctgtttccacagcttccgtggtgctctcttcgatggtcagataagccagtttgcctgccacatccgtcacttcgtatttttcggtcagggcttttacatattcccctgccttctggttggaaagcgtgctggaaatggactggcttgtggcatccgcatcgttggttctctttatgaactgcgccacataatatctgtggtttgtttcatcgggaaggatggtcagatcgccttccttgcggctttcatcaaacagccatgctgaaatggccgccggtgatccggcataggaaccgccttccgtcaggctgccttccttatccgcgccgccgtaattctccttctgttcctctgatgcattttccacacagagagtctcaaaatcttctccggcctttaccttttcttccatggcctgtgcgctcttcttcagctcgtccatggcttttgtgatatcctcttccgtggcatcctcggccagctgcgttgtgaatgcaaagcttctgtaatccactttatcatagctgttcttgttggcctcgtagtattcctgaatttcttcatcaccaggcttgttgatttccgtcaggtgctcatagtaagcatttgcaagcatattttccttcacgtagggcaggatcctgtccctggtcgcatagtcgccgtacatattgctgtaaagctcggacgcgctcacggattccgtttccgcctgtgcagcaaattcagtttcaaaggctgccatatcctgcgtatcatcataggtaaagccctgtgctgcggcatcgtcaacaatggccttcacctgtgtcagctggcttaccgccatctgatcaaaataatccttccaggtcatattgtcggtatactgctgctgggcaaaatcctttgaggtatccagtcccatatagggcagataggagccatacatggaaagatagctgtttaccgcattgttgtagtagtaatcatattctaccttagtgatttcatgatcgccaattttcacataggtgttgtggaccgctgcatatttcgtatatgcggacattcctatggatattacaaccgccgcagcgattgccgcgattataataatgcttcctattttaaaacgcttcagcgatttgagttctttttcctcctcaatccttctcttttccattttccggtcatattttgtcatgaccttttcgcttttttcttccgtcttcttattattagacatggtaagcttccctccttttatctctgtcaggtattatacctgataaatgtgaaacaagcgtgaactttttgcataaatccagctgtttttctctgaaaatctgcacaatggcacacctttttcgcattactgctgccgctaaagtcctgtaattcccggcagacagcactattcacagtataatacactctccttccggcttcaacaaaaattgttaattttgagggggaattttgttataggtggatgagtttgtccggatgtttggaagtgcagcggccagagggggaccggggtttcatgttatcctgctggaggcaatttttaagggtttgcagggtatcggaaaaacagatgccgtggcgcaggagtttttcctggtccatgcgcaggtttctggggctggcggcaaaggcttctttatttgggaccaggagcgcttcgtcggtgccctggaagctgagaagctcgcggacgatgtggtaagtgctcaggtcgttggggcttccgaaattgtagattccgggagggagggtgagtgcggtttccagatggcgtatcatttcccccacgtaggtaatgctgcgatagtcgtggatggggtaggtgatgcggcgtttttcactgacagcctgtcttacactggtgataagggtgtcgtgttcccgggggctaagctttttattgtcaaacatccagctcatgcgaagcaccacggtatcgggctgggcagtaaggcatctttgttcggcctcctgcttttgttttccgtaaatgcggcagggggtgaggagttcgtcctctcggtgcggttcctgtacgtcatttccgaagtatacctgatccgaactgaaaaaaatcatcctcgctccagtttcccggcaggccagggctatgttttccgcgccggttacgtttaccagatacgagtgtccgggatctttgtcacatgcgcctacgtcagaaacagcgccgcagtgtatgacaatttgcggccggacttgtccgataactcgcaggcattcttctttgttggtaaaatcaagctgtgcacgccctgttcctgtgatttcatgcctgtctttccaggcggcaataattcttgcggcggcaaagccgtctgctcctgttataagtattttcatgttttcctcctgcatatctcagattcgcctgtgatatagcaacaatcaatagtttgaagagaactttataaaattgaatacttctgagtaaattggcacaatcaaatcagcaaattcatcctcagaccctttctcaggccgaattgcctgatagtgtccagttcctccggcttcatgcagccggaatcataaagcatcctgtattctctggaaacactgctgttaaaaatcagcatatcatccgtattgattgttaccggtactccatagtcatagaacagccttatgggatatgttttataatctccggatcttcccaatattatattgctcgttgggcacaggtttaagcatatgtgattatccttcagaaagtacatggtctgtggggaagctgcagccgcaataccatgctgtacctcgtccagctccagtacctccactgcttctctcacatcctctgccgtcccgaattcccctgcatgcgctctcaggcaaaggccgtttgctttcgccgttcggtacaatggaacaaaatttttaaccggttgtgcaagttccctattacataaatccagagagcatatccaatgataaggaagcaactcttcaagctggcgaagcgcttcctctgcgtggcattcccatcctatggcaagttccggacagaatatagtatccgggcagtattttttccggaaagtttctgtcagccggataaaattctgaatttttccaagctgcaccagttcaccatagccaaattccatacataatactttaatatgctcctccgcggcccgggcaaacgcgccttccagacggagtaaatatccttccataccacgacaagatgattttatttcctcttcgaaccatagctgcatgtcctccagagacataaaaggagaacacctgcttttaattcttttaccggtgcgttccattataaattcctggcttcctccccgtccggcatgtacatgtaagtcacttttgggatattcctccaaaggcttatgatttttcaatgcttccgcaaagcttatttccatcccttccgctccttcacttcccccgcactgcaggctgcaaaatcaggaaaagcagaagcttctcttctgccccctgatatgccgtatcttttttcagtgtatcttcctgttttcttctgtctttcagtttatcccttcagcttggaaaatgccagaacaataaataagacgccgctcagccaggacagattccagctgagacgggaagcgattttccggccgagcagctgccccagccccatggcggccacgccgattaaaaatgccgccagcatggttgggagaatatgaatcttcaggaaggcggcaaaggttccggctaccaggctgtcaattgacatggcaaatgccagaaataccgtttctttcatggaaagcgtctgggaatgatcgctgtccgccgctgtggggttcccataaatactgataatgaactgcagctgggaaaaagaaaaatggatatccttgcgcacttcataatgatggttgatgtaatttttaatcaaagaatccgccagcctgattgcacccaggatgaaaaggctggtgaagcatatggccttggtcaggttttccggcaccaccgccgtcagtgccgtcccaaaacataatgcagcgcccaggcaggcgctgcatataccgttcatgacacccgtttccttccagttaatgcttatcccgtcagctccataagcaatactggctacaaactcatccatacagagagccagacataatactaaaatctgaagcatagtgatttctctttttattttagtatattctttctgcttatttttgacatacttttgcaggaaatggcatataaaggaactgaactttatatcatattgataataaaagaaaccgctattacagccaatgtactcagtaacgtacctaacagataatattctgcaaaatccggttcctttacaattttatcatatcttgcaattgattttgcagttaagaccaatcctattgcagaatattgctgtaatgatataaaaatcaacattatactgcgttcaatagttccgataagccggccagcatttctgtcatttttcctatccgaatctttacttttaggtttaatataatcatttaatagatttccaattatctctttaggatttcttatatgccggtatagcccgtaacttcgggcttttccggcacttttcctatcggaagaacctcacaaacattcttattacccctcatgtttccgctctcaaacgtagtacaaacagtagtacatattttgcgtatcctatgcggcttgggcctcctgggcgctctctgacgcaggctgcgcatggactgctgcggtggtctgtgcctgggcttgcagccgttccatttcctcctgtgcggaatggaatgtggcgtgggcataatagttcaacgtcataacgatattggcatgccccataatgtactgcaatgccttggggttcatgcctgcgtttgccattctggtacagaatgtatgccgcatggtgtgcggcgtcatgacctccggcagcggttccttatggcatttgttgaacttcttggcaaggccctgaaacatggcatcatagtggacagccgctttcggcagcccgtcccggtttaagaacaggaagcccttatatccgtccaccacaacgcctttgccgttctttcgcccgtgcagcacgcgctgaaatgccttgtaggcggctgcgctcataggcacctggcgataaccgctgtcggtctttggcgcttcgatgtagtagccgtcctcggtgcttctcaaaagctggtggtctacattcacaaagcgcttttcaaaattcaggtcggcaggtgtcaggccgcagagttcggaaacacgaagcccggtttccagcagaatcaatacctcgtcataatacttggcataaacggggtcactctgcatgaagtccaaaagctccttttcctgttcaggggtaagcggcacctttggtacggtatcgtcgttgataacctcattgatctggaagtcaaaggggttcttgcggaggcaatcgtcctgtacggccatgtaaaaaatggctttcagggaacgcttgccgttgcagatggtgtgataggccacacccttttcctgcatacgtaaagcccattctttggcgtcagacagctttacgctgtcgatgctggcccctccgattttatcctcggacagaagtttcattaactgctggcggctcttatgggttccccgcttcacattgcccctctgccggatgtacttttcatagagctggcacacggtcattttcttgccgatggtgtcaatcccatcgtcaaggtctttttgtatctgcttgattttctcacgcagggaaatatccgggcgttttccggcagggattttgtccgtggggactaacttccatgagtacacaaacttcggttctccaaaggcatccgtatatttgtaggtgtatcttccgtctgttcgctggctctctccagatttcaaaaggcggcctttgctgtcccgtcttttttcatctcgttctttttttgacatttcgtcatgctcctttccatgacggaaagagccttgacacactctaagggtattatagcatagtcaaggctctttttcactagattgtgtccagagaatcaatgattttttcaaacttttgccgtttgatctggatgcggttgccgttcaaaatcacccagccagcggatgggttttcctcggcaagccgccgcagcttgttttctccaatgcgaaaatatttcgacgcttcctcaatggtaagcgtatatttttcccaaataggcacatcgttattactcataatcttgcctccttatgttcaaaaaaaggattcttgtaactatgggcaaaacacggacggctggcggcccagctccacgggactttcacccccgcgtggttctcacacggccatacccattgcctgcgacgcttttaacgctcggactgtggctgtaagggagtatcattgtcctgcctgcacgtcgtcgcccataagcagccacgcctatgtggcggctgggtggtggtcgctccgctgttttcgtagaaaccagcatcatggcgcacccgccgtccggctcggtacagacagaatgtgtccgtatgccctatgacgcaccgccattgtcctgcgggcgtatttgtcaaggtgcatccatcagccaccaggtcggcggaaatgcggaaagggagttagaaaacatttccgttaccgtggccgggccgttacttcaaagcaacgatgatggaatggatgagcttgagttccaaacggtgcttcatatactcgtccacgcacacataagggatgccgttgctgtcgtacaaggtgcgggtgcagagcttgtttatgtagcctgcatagtaccgtagcacttgttccatagccattgcgtccccagcgtgggcagcttccatcaccgaaaggggcagaagttttctgccgttgaatgtgggttccttcatccgcgtttccctccctctggcatgagcgccatcaatttcaaacgcaactgtttcagggtgcttgtcctgtggcgctgtacggcgctgcgggacattcccatgaagcttccgatttctccgtctgccaaatccaaaacacagtgcaaaatcaaaatgctttgttcttgttgtggcaggctggcgaatgcctcggctacaagctcgttgtcaatgagcaaatcatatccatgcgacgaaaaaacgtagctgtcgctggggtaataatctaccgtggagagcttgtccaattcctgctgtgtcagggcgtccagcgacttttcacggtcgcgctgctgtcccatctcgcgcagataatctttggcctcattgcggagtaccgccttgcaaaatgcgtcatagcggtgccgcaggataaagtcattgcgggggatcgtatccatcttctcaccccctttctgtgggtgatttcggtggttctctccctttccgccaaagttacttttgaaaagccgccagctacccgctaaacaccactttttgcaacattttttgaaaaaatgtgtggccggtggcacgggacgcaggaaacaacaaaattcgcccggaagggtgtaaaccctccgggcgaacgtaaaaatagtatgatattttactgcatgggataatgcatgggtccggccgcatttttgactggccgggggatggctttttttaacggtgctactcccgtttctggtggtcgatctccctttttacacatgacagcttcctcctagagccgccaatcacgccagtgtcaggacgccatttccaatagaaggcgaagaaacggcagacttggtcttgaaccgccgaaggttaaggaatctattttacgcgcaggaaagcctctgtccctgcaacgtttttttttgcctattgggcggtgaagcgggtttcgtgtgattcacttcctattggtcggctgtttcttttaaccgttcaaaagattcactactaataacgtgttccaaccgacaggcatcggcttctgcaattttaggatcaacgcctgcggctatgagctgttccatgaaaaagcaatggcgctcatagatttttacggccacttctcgaccaatgtctgttagatgcagatagtgttcttcatccattgtcagaaagccgccctcacgcaaaatgcctactgcatggcacacgctgggttttgacacctccatgtgccgggctacatctacggaacgcaccatgtctattctcttatgcagaacgaggatagcttccaagtagtcctccccggatgcatgaagtttcatctcagcctcctagtacaaaaattatacggcccaaccaaggctttcctgctgaatatgaaataacttatggtatagaccgttcttcttcattagttcctcatgagtgccttgctcaaccaacttaccattatccaggacaatgatctggtcagtatccaccacagtgcggagccgatgagcaatcataataaccgtcttaccctctaccagttttgcaatagcacgctgaatcaaaacctcgttctctgggtcaagggacgctgttgcctcatcaagcagaataataggtgcgtccttcaaaagcgcgcgggcaatggaaatccgctgacgctcaccaccggaaagagtgctgccgttctctccaaggacagtctgataaccgtccggcaatcgctggataaattcgtcacagtatgccgcctttgccgccgccatgacctgctcctcggtagcgttcatgttgcctacacggatattgttaaaaacagtatcattgaacagggtcacatcctggaatacaaaggacatacagcgcatcaggtgttccggttcaatggtgctgacatctatgccgccaatggtgatctggccttttcttacatcccaaaaacgggcgatcagtttggaaatcgtgcttttgccgctgccggaaggccctaccagagccgttacgctgccagcgggaatagagaaagacacatccttgataacatcgtcctggttatatccgaaggtgacatttttcagttcaatgtcatatttggatacatctttgtccacgccctccatggtgggcgtggtcagcagggtacgcatacggttggtaacagtccccaagtgaaacagagaggtcaactgcgagagaatggcaaggatcggaccgtaaatttgcgtagagaacatcagtagaaccagtaaagaaagcagttcaattttaccgtttgttatcagcaccgttccaatgaaaatagtaatgccaagccctgcttgcaggatcaggctggctccctgaaccagaataccggaggccagttctaccttgatggcgatttttctcatagcctggagtgctttatccaacgcatcgaagcgggaaccgccaagaccacaggatttgataattttgataccttccaggtattcctgaatctggctagatgcctccagtttcacatccacctgtttgtcaaacagacgaagttgtagcttgcgcccgcacaagatgataaggaatgtaaccggcattgtgcagaaaatcgcaagggccattctccagtcaaaaaatgccagacaaacgcaggtcagggtaacagagatgatatttgcaatcagcggcgggatggtactgctaagcatggattccatgctactgcaatctgccatcatgttggtggtaatatcggacaaatcttttgtgttaaagaagctcatggggagcttgcgaagatgctccgcgatccgaagtctggtcgtgctggcctccttataggaagcaatataggttttcctataatcgtttttcgcggccaggaataccagaatagccgccaccagccctaggcccagcagcttccacaacgcggcccacgaaattgcttctcccgtaaacggctttaacagctcccaaaagatcaggcaggctaccattgatgggagcaataacgcgatattggttattgtgcaggccgtaattgcttttttcaggtcggaatagcctttctccgacagcattagcttttctttcagcttactcatagatcacaccgcctttcctgtgccaattttccagttgatcgactccgtatagctgctccacatctgcgcgtattttccgtccttcttcagcagctcgtcatgggtgccggattcaatcaggcagcccttttccatgacaagtatctggtcagcattacgaatcgtggacaggcgatgggcgatcattacaactgttttattttggatcagcttttcaaaggctttttgaatcaggtactcgttctccgggtcactgaacgcagtagcctcgtccagaacgatgatgggcgcgtcttttacgatagcccttgcaatggcaatccgctgacgctcaccaccggagagatggacgccggtactgccgatcacagtctgataaccgtttggaagctgctcaataaaatcatggcatcttgcagcctttgccgccgcaatcacctgttcttccgttgcatctggatttcccatacggatgttatccaggatgctctgtttgaacaggaacgtatcctgaaatacgaagctgaccttatccatcagcgcatccagaggaatatcccgaatgtcaacgccgccgatctgaatacttccgtccgtcacatcataaaaccgggagattaggctggcgatggtacttttaccgccaccggaggggccgacaatggctgtcaccttgccctgatccgcaaagaaagaaacatgagacagggccttgacctgggaatcggcttcgtaggaaaagctgacatcccggaaagcaatcccatagttttcgattgcttgcgccgtactcttttcgggcagggccgggatacgcaggatttcatccatacgctccacgctgccgtcaatctgcgtaaaggactcagagatatacatgattttattcaggacaccggaaatcgcatggacaataatcaggtagaaaataaatgtcagcgaatactccctgaaatccgtagtgtgcatcccgatcagaatgcccaccggaatcaaaagcagataaatattgttgatgatcgtggtaaaagcaggcatacagttctgccagcccaatgcgtactccaacacaaaagaggtatagtctgtaatggatttgcccaaccgcttaaaggaatcggcggtctgattaaatgctttgatctccgacataccacgtacatattccacagaagcgctgttcatgttctcctgggcggtctgaaaacggtgcattttttcctttgcttctccgttgaagcccgcaaactgcacgataaaggccagaacaataccgaccagacaaaccacgccataccgccagtcaattccaagaagaatgataaccagaacaagcggcgcgaccaaagaggccacaaagtccgggagctggtgagcgatgaatttctcaacactttcaatgttttcatccatgatctttctcattttgccgctgcccagggtcagatgatacccaaggggaatctgcatgatgtggtcggcaaaggccaccttcaattcataaagcgttccaaacgccgcaacgtgggaacacaacagggcaaaaaagtaaaatacgatgttccccaaaattccagccagggccagccatccccaggtcgagattgcggaaacattcaagagcgacatatccgggtaaacaaacaggatttcccgaatgatgtagtagattgataagtacggaacaaaagaacagatcgcagccagcgccgccaaaaaccctgccaggaacaccagccctttatggccggaagccagttccaggcagcgtgccagtccggttttcgctttcggctgcttcttgttttgctgtgccatttctaaccctcctttttgtcatatccaattttgtctaagagaagctctgcgcctctgatttgaaaatcatcggtaatgcagccgttctccaggcgtattgcccgctcacagcaggcaagcgcacactccgcgtcatgggtaatgacgataatggtgcgccccattttcgccagcttgcggatcatccggctgacattccgcatattcgtaccgtccagcccgcttgtcggttcatccagtacgataatcggcgcttcgtgcattagagccacgccaagagccagccgctgcttttgccctcctgacagcgtagagggatgctgtttgatgaatggcgtcagttccagggcctccaggatttcttccgccgcttgtttccgctccgggttgacttctgcaccggtagtcagttcgtcaagcaaatcctcaccgaatagctgactgtctaaatcctggggaatataccagacctttcccaagcggcctttcggtctacaatgctttccgaataaaacgacttcgccggatttctctttcaaaagccctgccaagattcgccctatggtgcttttgcccgtcccgtttgggccgatcagggctatcgcttctcccttatggcattgaaagtcaatatccttagatacaatcgtttcaccaaaagagtggttcagttttttcacttccagaacaacctcactggttgccgcagacgggatttccgtctgctcaatctgatgcaggttaggagtgcgaagccccagcgcctggatttccttattagtcagagctttcatctgctgtgcagtaaattcccgcacaattttccctttctggacacacaggaaacggtctgtcagatccatcagataataaagccggtgttccgctataatgatggtttttcccttcttcttcaaatcgtgaataatatctgcaaagcggtaggtagatgcaatatccagattggcagacggttcatccatgacatagatttcaggatcaatcgcctctgcggatgcaatcgcaaccttctgacgcattccataggacaggctgtgcaggctgtgatccaaaatatcctgaatcttgatgttcgccgctgcccggtgaacatggttctgaatttcctcatgggaataaccgtagttctcacagccaaaagcaatctcgcctgcgacctcattggcaaaaaactggctcctcgggtcttgaaatacatttcctgcgattttgccgcgttcccaggaaggaatctctttcagcagttttccatccacaaaaacctcaccgcttaattctccctcgtaaaagtaggggatcaggccgttaattactcttgtcaaagagcttttcccacttcccgatgggccggtcataacaatgacctccccggcggcaatgtctaatgatatatgttccagttgatttccgttcccgccataggaaaaggtcaggtcacggatcataatttcttttcccattccattcctcctataaaagacagcagcacacggcagctcccacgctgacaacaatcaaaacgcaatccagcacagcgatccggctgacatagtagctttctttcttgtaggggctttcaattcccctgactatggcagaagctgctaactcgtccgcgatctttaaggagcggaacaccatcggaacaatggcgtattccaacgtgtccattggatgcctcaaaacattgccgaccgattttaagaagctacgaattttcatggcttccctgacttctccaaattcatgcagcacagtcggcgcaaagcggagcatgacgatcaatacaagcatgatatgggtagaaatcggcattcttctcaagctggccgttaatttgccagaggggattttagccagaagataggcaggcatagccggaagcaaaagtttgtaaaccatgctgagcaacagtggagatgggacactgattttatatttcatttcaatcagtagccatacaagtgcaaccatataaattgaaaagcacccaatcgcctgacgaaacaaactaaaccagcacaggatcaaacaaatccaaagggtaaaaattccatgtcctaaaaaacttgttgtaaggaaagtaacaagacaagcgcacagcgtcaggaaaagaactgtgcgcccgtcaattcgatcaatccgtctgctttttgatacggccatcatcctacaatgcctgccttttggaaatgctttctgagcagacgctggccaaacaacgtgccgaggattgcaagaaccgcagtaataacaacgcccaaaagcatcagcgcaggagacgttaccatagagagctgcatatttaaagtgttggcatcaaaaccactgtttgcagccatttcctgataactgtcccaggaccaccacaacggtacggcacaacctacaaaattaccgattgagttgaccatccagccaattcggttacgaaccgcactttggtatgtattcttgccaaccatgcacagttcggcaacgagagctacaatcaaaaaatagggaatcaagaacatataacccataactccttgaatcaccccataaaccgcagcccatgcaaacaacagtccgtgtttgttgacgcggtttgctgcaaccagataaaagattgcgccgataaatgcatcaattccggcagagccgtacaaatatactaccggaaaaggcaatgtaaccataccaattatcattgcaatagcaaaattgatgaccatcattgcggcaatcgtcataatatcgcgaatgccaaactttttcttcaccgtttgttccatctttgaaacctccttaaaataaaatgacagcgtagttagtaataactaactacgctgtcattctacaccggtttgcagtctctaactactccaaagggaaaagtaaatcaagaaaacagcccaaaagttaaatcacttttttgctttacggtaatcctttggaagcattccaaacacttcttgaaaggctcgcgcaaatttactaatatttgaatatccaagttcaccggctatttgcgtgattgattgatctgtttcctgcaaataaacagccgcaagattcattttatactttttgatatgtgcatagggcgtatcgccataaatctgtttgaaaatagcttgaaatgtgaccttgctcattggctcctttcgcaaaagttcttctatagatatttttttgtcgaggttttctatgagctgttggcggatgcgtttgatgatttcaatttgttctttggcataatacgttgcctcatactgatcttcaatccgcagctgtttgatatggtaaaatagttccaataatttgatccggaagtaatttctcccttcaataccttttgccgcgtacaattcatcgaagatatgtaacagacgctgaggcgttcgacataaaaaccactttttttctaattccagttctcgtcccagatttagaacatcaatgttgtagtacgaaaaaatctgttgcgtttccgcatcgacagaatccttatcaatcacacagcttagtcctacgccatatccaaagggaaaagaataggccgcaggaatattagcaagagcattgatacataattctccttcttttatatgaaaaaccttattattccttagttcaaattcaacgcgccccttttggtaatgacgaatttcaatgatatttttatttggaatgggttcacggaaggtgtctgtacaattaaagtccataaagatcaaatcaataccaaggaacagcgcataatcatatagaacccctattccattgcacttgtattcaactttcgtgtaatcattgcacacctcagcgaatgtcgcaccttcaccataccattctaagccatgatgttggatcatcagaatagccctccttttggttagctgcttctaactataatatgccatttgaaggaagcagtcaagataaagccaaagtaagacttgcagataacagtattggtagaggaagcgaagacgctttgtccgttgctgcacgggcaaattatgttattgtttcttgatgagggcaggcagcctggagccgttcaaaagcctctgtgctaataaactctgaaaacaacgctatatgcagaccatgaagcctgatcagatataagagtaatgtcaacacaatatagaacaaaccgaaagagcctaggaactgaaaatttttctcttaaccaacagatagaggaaggcacacaaagtgaatatcatttttcacagtttatcagcacaattattgaccagtacacaaaataatattctctattctgtgtgttgtggaggccacaaaaaggcctcttatttttttgcaaatttttctttccaaagcgctattttgcgggtagtttgaaagcttttcagagtattaggagtggaggaaaagaaaaacagcaagcatagggagtgtggctacactcccggcaaacggcttcccgtttgtatcttggggaagtccccaaacccctgaatgaaggaaggtgagaaaatggcaaaccgaaaacggaagtttgtgctgcgcgtccccgtgacgccggaggaaaggacgctcattcaagagaagatggcccagatcggcacaaggaatttttctgcctacgcccggaaaatgctgattgacggctatgttgtccaagtggataccagcgacatccgggcgcagaccgcagagcttcaaaaaatcggcgtcaacgtcaaccaaatcgcaaggcgtatcaacagtaccgggactgtgtacgcgcaggacgtggaggacatcaagggagcgctggcccagatatggcagttacaaagatccatcctatcaagtcaacgctgaaaaaggcgctggactacatcgagaacccggacaagaccgatgaaaagctattcgtttcctcctatggctgttcgtatgaaacggcggatattgagtttcaaatgttgttagatcaggcgttcaagaaaggcaacaatctggcccaccacctgatacaagcctttgagccgagcgaaaccacgccggagcaggcccacgaaatcggacggcagcttgcggatgaagtgcttggcgggaaatatccctatgtgataaccacccacatagacaagggccatctgcataaccacatcattttctgcgcggtggatatggcaaaccagcgcaagtatatttccaaccgccagagctatgcctatatccggcgcaccaatgaccggctgtgcagggaacacggcctgtccgtggtgatgccgggcaaggacaagggaaagagctatgccgaatgggacgcccagcgcaagggcaagagctggaaagcaaagctgaaaaccgccattgacgcggccatcccgcaggccagagattttgacagtttcctgcggctcatggaggcgcagggctacgagatgaaacgcgggaaattcatttcattccgctcccccggacaggaacgctttacccgctgcaaaaccttgggggtggactacaccgaagaagccattacccggcgtatcaaggggctggctgtggacagagggccgaagcgtaaagtggaacagggaatttccttgcgtattgagattgaaaacaatatcaaggcgcagcaatcggcgggctatgcgcggtgggcgaagctctacaacttgaagcaggccgccaaagccttaaacttcctgacggaacaccagattgagagctacgagggcttggaaagcaggctggacgagatcagcacagccaacgacgaagccgccgctgccctgaaagcagtggagtgccgccttggagaaatggctctgctgataaagcagatttccacctacaagcagaccaggcccgtggcgctggaataccacagggccaaagacaaggccgcgttccggcgagagcatgagagccagcttattttgtatgaagctgcggcgagggcgctcaaagaggccgggatgaagaagctccccaatctgtatgcgctcaaagccgagtataaaaagctggacggagaacgggaacggctgtcagaacagtataacgaggtaaagaaagagctgaaagaatacggcattatcaagcagaatgtggacagcattttgcgggtgacgccgggaaaggagcagatacaggagctatgaacataccgagaatgaattaccgccagtaccgcaaggcccggcggctcacgcatgagtgttgtaattactgtgacggaaactgcctcctgctggacgatggcgaggaatgtgtctgtgtgcagagcatttcctattccgtgctgtgccgatggtttcaggctgccgtcctcccgctggacgcgacactttatgccgaactgatggagcgaagccaagcgcggcgttgccgggaatgcggggcactgttttctcccagacgtccaaactgcctctactgtccagactgtgccaagaaacgcaagcgccagagcaagaagctgtgggcaaggaaacaccgggagcatgcgtagaaaaagtaatgggaaaaggccctgaaatatcagggctttttcctttggtcagaggggtgggtactatgttactaccttttctcctggaagcggcatttactttttctacaaggtgataccgatatcccgctctcatttctgcgttgccattctgtttctttttcctatggctttccccacaatcatatatccttgaaaaatcagtagatttttcgatggagtttctatataataaaatcagttagttaatgcgaacttagtaagagcaaggaggttattccatggggattctcaaacagttttttaacaacacccgaaagccgaacggttggatggggaaattgatggtcaacggtatgaatcaagggcatgccgctgtttccgattggggcctttcctattttccagatgtaccgggggcagctcattctatgctggcggatttcggatgtggtggaggacgcaataccgcagaacttttaaaacggtttccggaggcaagagtgacagccctggattattccaaggtcgcttgcgacaaaacaaagcaattcaatcggaatgaggtgcaggctgggagatgtaacgttgtgcagggggatgtgtcccgccttccctttgaagcggcgacatttgatgtgatcactgcctttgaaacggtctatttctggccggggccagtggagagctttcaagaagtctggcgggtactgaaaccgggcgggacatttatgatcgtgaatgaatcggacgggacaaatcaggcagacgaaaaatggactgacattatcgatggaatgcgtatctttacacaggagcggttgacacaatacttaaaagatgcaggcttttcccagatagccgcacatgtaaatcggaaacaacactggatttgtctcctggcggagaaagcacggtaagaggaatcgccgattcaaaattcggatttatagagatttcttacttacaacataggatggagggatagaatgacacgcggagagatttggaaagattttttgaaacatactgttttgaccttggtaatcgcactgtttctgtttttgatcttcaagtctgtttttaccaaaaacggcgaaacggaatatttttatgtctggctctgttgcgggattccctttgggattcggaggatgtttgtctggctggttccccatggatatgacttaggcggcacggttggtattattgcggtgaactttataataggcggcctgatcggcggggtcatcctgacctggcgtctggtggttgctgtatggtatattcctcttaccatttaccgattgctcacaaattgagttggatttctggttgagttctaaaatgtcagggaatacgtagaaaaagcaacggggaaaagccctgaaatatgggggattttttcttagtcgggagtatatctgcgtgttattatcattccccccggaatcagaggttactttttctacaaatggcagcgtagcttctttctccttgtttgcctgataggataccgccaaaagaataagcgaggggaggtgcggcgaagaaagaccgttcctccctccgcaaatggagtatttatcccggttatgaaagtttagaaagccgagtaagcatcccactcacgccctcccatagttgttcctgccgctgagatatatcctccaaatcagcatcataaatacgcccggtttcatgcactttgcgggtcagttggtttaagttgttgctgctccggcgcatcagggagaccaactccttcagctccggcagatccagcttgcaccacatagccgtccagcagccattttccgcagataagcgctcaaattctttgtcccaaactgctgctatctttctgatggatcagttccagttcatcagcggatacccaaaacaaaaccggaacatcccgcttgcgtttggggcatggttatcgctccggctcccgtttcttcggggcggcaggtttatgaatgagggcagttcttgtctgagcttacctatgaaggacaggacgttttcagcttttccctgtgtggtttttctggcttgtctgctaaacaggtcggtcagaccgggattcaccacatcaataaaacaaccagaaaagcagagtggcgaggaaagtacacgctgtcttcgggcggcttaggaatggttttagcccatactttattgtcctgggaaatacgcccatcacagttcttaagctggacggtgtctagacagaacataaactgtacacgctccaccccgtaggtttccagcacaccctttgaccgccggcctcagataatccagtcggaatttctccgcatagtgagcgccgatggtctgctcaaatggatatttttgcaggcgatgtttacattatatgaaaagttgtactgctgccagctccccatgttgggacgcataggcagcagaatggggatagagagggatagttcgtagttcctctttggccctgcacacatcgtcggcacggctctcaatgctgtcccggatcacatccatataaccggtctccagcttttcaaaatagcggtacacatccgccagcggcgaagaagattccaaaagtgcctgggcctgggcatcggtcagctccagttcctccatcgccatcacgatgtcctcacggatggtgtactcataggtgtggtgcaggatttcttctgggggctggcttttcaaccagtccctatatttatcctgctcagcggccatcttttcataaaggaccgtattcagattgttggtattcataattatcgtacctcctcatgttgttttggtttcttttcaagggctgcggggcggcacagggcgtttcaggctgtccagcaccgagggacgcgcactcttggcagccactgtttccggctgggtgcgtgggcctttgccgtcaatgttcagtaaaggtactgagttccaccagacgggcggacttgactccgcagatcgtcctcaaaggggaacggcttgccaacttcctctttggcagcggcctgctgctggtaaaggttctccagctggtttttgaccgcctccagacgctggggcatctgcgccagtgcgttgtcgatgcgggtgagatttccgcgcgggtctgtaccgagggtcgcccgatgggtcatttgtcctttcagcaggagcgtatattcctgtttccacgcttgaaattccaccgacatagtgaatccccggtaactgccaatctgcaccggatcggaggttttgacctccttgcaggcatccaaaagggctgcgccggcgttctccttatcggtcagcagatcgccccggatttccataccagcaaaaccgtcctccgggtgcgggtgcgctgccaaagcctccagatcggattcaaagcccttgataaagcctttgtgtttttcaatctcctccgggaagtatttgagcaactggtcctccagacgatattgcttgctctggtggtcggctttcatcagcttcaggctgggatacctccacatccaaatccatacgctccttgatacgggggatctccggcacacagggccttgatctcagcaaaacggaaagcgccgtttcatccacatcatcgcaggagcgtcactggcgatttagaggtcatgatctgactaatgaatttctgcttgttttccaccgtctgccagaggtaggcatcaaaagttccctccgtgacatagcggtacacatggacaagaggattctggttgccctggcgctcgatacggcccttgcgctgggcaaggtctcccggacgccacgggcagtccaaatcatgcagcgccacaaggcgatcctgcacattggtgccagcgcccatcttggcagtgctgcctaataggacgcgcacctgcccagtgcggaccttggagaacagttcctttttccgtacctctgtgttggcttcgtggataaaggcgatctgctcggcaggcatcccctgggcgatgagcttctggcggatgtcctcatagatggtaaaggcaggctccggttcatccagtgggattgcttcttccaacccgtgaagcagcggattgtccagctgtttgcgctgccttgtttgcagggagcttttgcctggggtgtggaaatgtcgcagaacaccagctgggtcagcttgtctgcttcgccatcccgccagatctgcatgatgttgtccacgcactgattgacctttgtgccaggttcatccggcagcatctggttgacgatcctctggtccagtcccagcttgcggccatccgaggtgattttgagcatattatccaccgacgggtccacactgcctctgtgtacttcggaagcgcgctcagagagtgccttcaccatttcctgctgatgttcggtaggctgcgccacgatgttgtggtattccacctccggggtgggcaggttcagttggtcggcggtcttgatgtccgccacttctttgaacaggttcatcagctctggcagattaaagaacttgctgaatctcgttcttgcccggtagccggtgccttccggtgccagctccaatgctgtgacggtctccccaaatctggaagcccagcagtcgaagtgggtcatgttcagttcttgcaggcgttcatactgaaggtaacgctgcatggtgtaaagctcggtcatggagttgctgaccggggtgccggtggcaaaaatcacgccacggtttccggtgatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacacccagctgctcgaaggttaccacatcgtcttttcgcccctcggcttgcagcttttccagtctggcttccagagactttctggtacgctccagctgtttgacggtaaaacgctcgccgccactggcctgtacctctgcaatcccctcagtgatctcgtcgatctgttcatagagaagccgttcctgacgctcccggctgatggggatacgctcaaactggctgtgtcccatgatgatggcatcataatcacccgtcgcaatacgtgcgcagaacttctttcggttatgggtctcaaagtcctttttggtggtgactaagatattggcggaaggatagagacgcagaaactccgacgcccactgctctgtcagatggtttggaaccacaaagagagatttctggcacagtcccaggcgtttggcttccatcgaagcagctaccatttcaaaagttttgcctgcgcctacttcatgtgccaacagggtatttcctccatacagcacatgggcaatggcacttttctggtgttcccgcagggtaatggccgggttcatgcctccaaaagtgatgtggctgccatcatattcacggggacgggtagagttcatttcctcgttgtactggctcaccaaagtctggcgacgctccgggtctctccagatccagtccctaaaggcttcccggatcgcctgctgtttttgagccgccagggtggtctccttggcattcagcacgcggcgctcttttccgtctgcgtcctctatggtgtcatagatgcggacatcccgcaggtttaaggaatcctccagaatcttgtaggcgttggcgcggctggtcccataggtggtataagctgccacatcgttgtaggatacagaagattttcccttgatctgccattcagcggtaaaggacgaatagttgacctcgatactgcgttggagataaaacggggtattaaaggtctcatacataaactgctggatatattccttgtcaatccaggtagcgcccagacgcacctcgatctccgacgcatccaggtctttgggctgggcggcggtaagagcttccacattgactgcataaaccgggtcctgctgtgcggcccgttgcgcctgacgcagtttgcggcgtacattgccggagaggtattcatcagcagtcacataatggggtgtgccgtctttctccagctgtcccggtacacggaagattacgccttgcagctctccggccagttcttcttttgtttttccggtaagctggctcatatagtccatatccacgcaggctttttccgagatagacaccgccagtgcttcacttgccgtatccaccacagccaccgcctgatggggcttgatggtccgtttggtgaacatatccgccttgcgttccagctttccgtcctcgtcgatgacttccagcgcacagagcaggtaataggaagaatcgtctgcaaaggccagtcggttcgcccggtcattgataagaccatattttgcggaaaagctgtcatagagccggttcagttcggcctgtttatcctgaatggcgctgtccggtgtggcagcgtccatttgcagatcaatgagctgctggacacattcccgcagccccaccagcccttttacacgagcttcggcggtggcattcaggtcagggcgcaccatgcggctgttttcacggaaatacacagtgccgtccacaacggtgtaggagtaatttttcgcattggggtcggcgggaatggaggtgtcgatagcttcgccctcacccagctccggcagctcggcctcctggtaagtgccgcgaatgtacttcacggcatcatgcagctgatcggcaagctccagcccctcaatgggattcacggtgtagtccatgccatgggcggtgctttccggttcctgtctgcccagcaccatttccgggtggccgataaaataccggttgatggcaaatccgtcgtccgtctgtccggtttgagtccattccggcacgatgtccagcgggcggtcccgcttttgcaggaagatgatgtccgacacaacctcggtccccgcgttggccttaaacgcattgttgggcaaacggatagctcccagcagctcggcgcgctgagcaagataccggcgcacagtagagtccttggcgtccatcgtgtagcgggaggttacaaaagccaccacgccgccgggacgcacctggtccagtgctttggcgaaaaagtagttgtgaatactaaaattcagcttgttgtaggctttgtcattgacctgatactgaccgaaaggtacattgccgatggcaaggtcaaagaagtcacgcctatcggtggtctcaaagccgcctactgtgatgtccgccttgggatagagctgctttgcgatgcgcccggaaacagggtccagctccacgccgtacagacggctgtttcgcattttctccggcagcataccaaagaaattgcccacacccatagacggctccagaatatttccggtctcaaatcccatacgatccaccgcttcatagatggcctgaatgaccgtagggctggtgtaatgggcgttgagggtagagcttctggcggcggcatattcctccggggtcagcagctcttttagctgagcatactctaaagcccatgccggtttctccgggtcaaacgcatcagagagactgccccagcccacatatcgagaaagaacctcctgctgttcggggcttgcctgctgtccggcagcttccagctctttcagcaaacgaatcgcattgacatttgcctgaaacttggctttcggaccgccttcgcccaggtggtcgtcggtgatacggaaattctcagcggtgcggcgcaggttgtccttgtattccccgtaagcggcttcctcggcggctctggcattgggaaaagtctgccactggccattgacctgaatggaaaccgggtgttcatccaacacttcctcaaaggttttctccggctctgtcacaggcgctggtggctccggctcctcgatatgcagtcgttccaccaccacatcataaggcagattgttcttatcgcccggatagacggccatggtctcggaatggaaggtcggggattcggtagccggttggggctgttccggtcccaaaccgtcctgctgacgggcgtacatcccgcgcagcaaaggtgcaacctcatcccagcggaaatacagcatagccagacgcttttcctctgcatccatgacttccagctctatgccctgtgccgtggtacggtaatcggcaatatcgccagtctccagattcagtgtctcgatctcaccggaataggctctgctcagccagtaggcgatctcgctgttgctcctgccggattgcagcagcgtggaaatctgctttttatccgcttcatccatcagtccatgagccaatacatcccgcaagtcctgatctgccttgtccgggtcaataggaagaaactcggtatagtaagcattgcggcggtctgcccgaagcagctgctcgaactgttctttgcgctctgcccggtagatgggatataccatcccggtgggcagaagctgtacggtgtcctcccgcagctcggtgatctgataggcgtcatcctcgatatacacggtatcgcccacggcatagaccggggcggctgggtcataggaggttctttgcggaactgggcggcgaactgcgtcatattcctcatcggaaatggaaacttcggaagtctgctctgtctcggcatctgcgatctgctctgcatctgacatcacctgttggataaacggggcattgtccagtttttccgggtctgtcacctgtccgttgacgatccctctttcttccagagcttcccggatggcgattgggtcgatgtcgtcaaaacggttctgttcttcttcggtatagaaccggtcctcctgaatgagctgggcaagcctgcgctgtaccttcggccagggcagctgcgtttcctccgggctgccggcacggacaacgaacaggctgttgctgttactgccgccgtattcctgagccagccatgcggcggtatctttttctcttgcatggtctttcatatagcggataacagcgtgtttactctcgatattgccgttccatgcacaaatggcagtatcaatatcttcctgagaaagagggcgcagaagttcatggagctttggataggtttcgtcgatcacttcccggtgcagacgctggcggaactccggcacatccgaatagaggcgaatcagctccatatccttagaaccaaggaccgcacggcgcacagcggcattgccctcgatgacaacattttcacggtcagaatgcccgcaggcattgcggtatgcggcatcctcggaaatggcggcagtcgccacagtcttatactgctcaaactgctcccgaagggtaggctttggcgtttcttcctccacctccggctgctgggcttggatggcatcttcttctgccaattccttttcagcctggattttgtcatactgcgcctgttcctgttcggtaagatagcggcctttctggacaagagaggtaatgcgcttggcaaccttttcccagttcaagtgaacatccgggcagtcctgctttttatagtgcaaccctttcccgtcgtgatcttcgccgctgtgtgttgcgccggacagggcatgagagcgtccgccaatgccatactcgtctttgaggaatctcactttttccttatccgtatggttttccatgaagaacgcatagatacggccttttcctccggcgaaactgcttccgccggtcatggcggcgtcgatctcatcctcagtaataaagtgctggacggttggcacttgggaaagctctgaagaaaaggtcctgcggggcaggtcaaggtccttcaggttctcccagatctccctcggtctatgatagtgaaaacgcaacaggtcacggtcctgctgataggcagtccagaaggcggcgtattcttccttgagggtctggcggaaagccggttcactcagctgctccatcaggcggcgggtctcctccgggaaaccattgcctttgatctctgacaggcaggacaaatatccgccttttcttgcgtcctcactgagatcgtgatacagatgccagaggttttccgagaggagggagcgttcatagcctgccgcttctgcaagctccacattggaggcaaactgaccactttccaaaagctccccgatacgctctgcggcactctcccaggaaatgacctgggcagacctgtcataacggacagacttcccatgggaaagatggataccatcctcggcataccatgcgctcacactgccaaggccattgccgccgtggtacagcgttttcagtatctcggcaatctcagcggtggttttctgcttttcaaaggctgcaaccacacgctccctttgacggtctgtattgccgcccaaacgcagcacatggtcgatgtcattttgggtaaaagaaaaagcagaggatgtatgcgctacattctctgcttcatctatggattggatctgttccgcttcggagaggaacaggtttagagtcagctgttgataagctccgccatcaggatctcctcggcctgagctttgcaggtgttcatcagccccacccacttcatgggatcgctggctttcaggtcctcggtggctcccgcttccttcgccagctggggcatcatctgctccagtctgctctgggcggtctcgtcgatctccagaaggtgcgggtacagcttctcgctcagcagcatctggttgtagaggatgggacggtgttccttcaggtaggttttcctcatccttccgtacttgcccaagggtttctccggctgctggctcagcttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgctccgatggttgccggagtattgaaatcaaagatcgccatgaaatcttcgtggtcgaagtagcgttccggctccagtccacagcgggacatcaaagcgtaagtgatactgacggtggctgctgccttgaactgtactccgatgttaaactcatcatattcctccaaaaaggaaccgtcaacgatatagaagaagtcctgctgatgctccgtccagtattcctcagccagttttccggctacctcggtgagctgtccggcaaggtcatcaccggaaacatcataggtgcgctccagcatgacctgcacggaatccagatggcgctcctccagctgccacagccagggagtgcgggaatgttcacgggttccggtgtcggaaatatcaaaaacatagcgcaggcggggtctgtccccggaatcgtccaccagagcgattcccttggagccgcgccttacataccggcccatcttttcattccacaaatcgtactctgcacaggcggtagcgtccgggcgctgggcgtagatcatcaactgctcatggaacgggtacttgtaaaggcgggaagcagtggtgagaaaccctgcccattcctgccagctccccgtgagctgcgttgttaccttctccgccatctgtgcatatagttcagctttggttggcatagtgttctgtcctcctttcagttttggggtaaaaaggtggggtggcatattgccaccccatccctgcgattatagtgtttactggtcaaaatccggatacaactccagctcggcaaactcggcatcactcatggcctggagcttgcccagtgcgctgtctgtcaactcccgcagctcggtttcctccggggccagctcgccgcgcatctcacgcaggctgtcgatcaatccggtgcggctaccggtattgtaaatgcacatcaggttcatttcctcaaaagtaaagtttcccatatcaaatctccctttccgcactctttttgggcgctgtctttttgtgttctgccttgggctggcttttcagctgctccatgacggactttttcttttcccgttcctcccgatgggcagcggcagccaaatccatgagggaaatggactgaccgctgcgggcctgctgttccagctctgccaccgtaggctcttttgcgccattgttgatgataccgtcgatcatgccgtaatcgtcctccacggccatctccgcatttttcagcggattttccggcaggaatccggggatctgggtaaaaccaacactgtcacagtaatgacaggataccttaccatcctgcttgatcgcaacgatgtcactgacactcatagaaggactgtgaaaatccgccggtttttgcagattaaactgctcatatagtttttccagctgctccggtaccgtgccaaactccctcagcggagcagtgtaaatgagatcataattgctacggtctatggaaatgtcatgggactttagccagtccagattcataaagcgcacattctgcggatcgtcacggctcacctgatagatggcaaagcaatctctgttctgagcaagaaatgcctgttcccgttcctgctgatgttcctgacgctccatgaccttttcgtggaactgagggcttttctcccattcctcacggtccacgccaaaaagaccgccatgatccatgatttcctgcgggtcaaacaccatgctctccgtattgtcctcatgcagcacatagacagtcaaaccagcggcatccagttccagcgcccgttctctggtgacagggagcatcccatcataggagtagccgtattcctgcatatctggtgtggagacctgctcatccggcatggggtattcatccagtgcctgctcttgtgcttccggcagctgagaagaagcagtcatctgactgacctctgcctgcatctgctgataggcagcgtcctgcaaggtttcaatcatagacaggggcgcatactttactgaattgctgctcaaatcgttatcatcacaaatctggagaactgccttcatgcaggaaagctccggcatatccagctgacctccatccagctctttcatggatgcggcatcgtaaagggtatagtcccagccgctgtcacaggactggatatgaagataggtggcattgtcgatcagaaacaaagcctcctgctgattggcgtccgcccccagcacctccatttccggcattgccgcagccagttcctttaccgctttttgcaccagaggattatcacggtaatagtcgattgcctggatggtgtccaggtcaatggtttggccggtcaaaatcggaaaaggtccttcatagtcgcttccgtctttcagctcaaaaccaatgcccttgatcccgttcattcgctctgctggaatctcctgataaatgcggacagcttcctccaaagacaggttatcgtggtattctccgaggtttggaaattccatgcactctgctacatagtaggtcagatcaccggtcggcagcctatcagataccttaatggcatctgctggctgctctatcggggcggtttccggctctacctttgcatgagggtcgattccgcgctctttgcagatttccttatagtggcgctcaatgtcggagatcaaagtgccggaggttttgttaatggtctccaaactggctctcagttctttcagttccttgccctgactccagcttgcaatatagccgaagctgttttctccggtctcgatgccaaaatacttgcagaccgcataggagatgctttcagcctccacttcctccgtgtggcggtttttgattgcctgtttttctgcggttggatcttcctcaactgcaagacgccattcaaactgattttcgtccacataacgccaatccatatcagaagcaaactgttcggcttctttttctgtggcaaaatccaacttgaaatcatgtttggttccaccttcactctcctgcacaaccttccatgacggtagcatttcatattttttagggtcatggagcttgctgtgggcaatctcgtgtactgtggctgaaaccgtctgaacctcactcatgccctgacgaatggcaattttctgatgatcagcagaaaaatagccgtccgtatcagcggccattgcttcaaaagtaatcggcaccggtgcgctgcggcgcagggcctccatgaatgcctcataatttggcacattgccggaaagggatgatgcaagctccggcaaaggtttcccgtcggtctggctcacatcaaagaccttgaccgggcggaacatgggaatctcgatttctttttcctctgtgacgatctttccgtctttatccagaatcggagccttggtatccgggtccagcttctgctcctcgattttcttcttatacggtgtgggagcgatgatggtaatgccatgctcgcccttttttacatgacgctcaaactggtctttccacttattgtatccggctaccaatgtggcgtccggcttctgcatatagatgagcatggtgttgtttaccgaatagcggtgaaagcgggacatgacggacagatagcgcatatacttttcactctcaaacagttctttgatgccctgctcgatgccatctgtgatttcccttagccgttctcggttggtgggtttgttctcagccatgattttcaatctcctttccaagtgtgtgatttctgctgtgtgttctgcaatccatgccttttgttcttcttcactttcataaaggaaaaggtccagcaggtattctacataggctttcttctggattgcttccacaaaacgggggtgcggttcttcctccggtgtcctgggagaacggtcggcttcccattttttcagcagatagtagtaatcggacagtacgcgataacagcgctgtcgatcctcccgaaacttctgtgcctcggttttttgccggacatatctcctgcggggcggggcctgactgtcatagatcaggccaaagtcctgtgccagtttctccgccgcttcttttggggagaggttaaagagctttgcggtaaagtcgatcacatccccatctgcaccgcaaccaaagcagtggaaccgctggtctaccttcatgctggggttcttatcatcgtgaaagggacagcaggccataccagttcgactgacttttatcccgtaaaactctgccgcttctctggtgctgaccgactgcttgaccgcttcaaatacattctctgccatgtgcctttaactgccggactttttcacagggggctggtatccggcggctttcgcacgctcactggcagctttgcgacgctcggcgctgtatggctcccgaactgatacacaccgcttggggacggtaaagttatgggcgtcctttcgggtgatctggtcggggtgcttttttgccagcagttccagcttctccatcagacggggatcgtgggtatagacctcagccattggttctgcctggttatagaggagaatggtttcccgttccactaaagagagcttcatcggctgcctcctttccgctggtcaaattccagcttgaagttggcatactgtccatcgtcctccaaaaccacagtggcatcgtaggtcttgccggttttctccgaatatagccccgtcacacggacacagccatcgttcagcagcgcagacaccacagctttggtcggctcttttttcttggcagcccaccatttgttgtttttccagattgcaaatttgcaagaatcattctgacagaagaagcctttttgcagttctgcaacttcaccgccgcagcgaggacatttgcccaccacctcacggggcggagtgaacaggtactcagttcccttgatgacctgataagtccccaccagatctttcagcatggtgctgatcctgtctaaaaactcctccggggcaagctgcccgcgctcgatctcgcccaggcggtactcccactcggcagtcagaagcggcgattgcagttgttccggcagcactgtgatcagggaaactgcatcgtgggaagggagaagctgcaccgttttcctgctcttttttcgttccagaaaaccggcagataccagcttttccaaaataccggcacgggtggccggtgtccccagaccttttcgctcggcgtcctccggcatatcatctttcccggcagtctccattgcggacaatagggtgtcctccgtaaagtgctgaggcggactgcttttgccttctttgacgattgccgcagaaaccgaaagtgtctgtccttcggtcagctccggcagggctttctctacgccctcttttttcggctctgtatccttcattttggcacgataagcgtcctccagtgctttccatccggggtgcttcactgtttttccttttgtggtaaactccccaccggcacacgctgcaatcacaacggtttccgaatagatatggggctgggctacggcgcacagcagacgcagggccaccagctccagcaccgctttttctcccgcaggaagggcagaaaggtctgcatccttgagatttctggtagggattactgcgtggtggtcggttactttcttatcgttgattaccgtctgcggatcacaggtaatggcgattcctttgcgaaacggcatagcattggcaaccagattcaccagcaccggcaggctgtctgccatatcgccagtcagatagcggctgtcagtacggggataggtgcagagcttcttttcatacaggctttgcagatagtccagggtctgctgggctgtaaatccaagcaggcggttggcatctctttgcagagtagtcaggtcatagagggcaggcggcttttcggacttttccttgcactccacctttttgattgtgacatttacaccctgacaggcttctttcagctgcttagcagcagccttatccgccatgcgctccccggatacggtaagaccgggcagctccagcgccacggtataaaagggaatcggctgaaaggtgtcgatctcagcttctcgctgaacaataagcgccagcgtcggggacatcacgcgcccgatgttgagggttcggtgatacagcacggaaaaaagccttgtcgcattgatccccaccagccagtcggccttggcacggcagagggcagcatcccgaagtccgtcatagtccgcaccggggcgcaggtttgcaaagccttcccttatggcggagtcctccatcgaagaaatccagagccttttcatcggcttcttgcaacctgccagctcatagacgctgcggaagatcagctcgccctcgcgtccggcatcgcaggcatttaccacctccgtcacatccggggcgttcatcagctttttcagaatatcaaactgctttttcttatcctttcccactaccatctgccaatgttccggcaggataggcagatcaccatatcgccacttggcatactttgggtcatagctgtctgcatccgcaagaccggccaggtggcccacgcaccagctgacacgccagccgttgccctccagatacccgtccttacgagcagttgcaccgattaccgcagccagactttgtgcaaccgatggtttttcagcgattaccagtttatatctcatcatcttcagcctcccattcttcccgcacaggcgtgtgcagttttttctctatgctgttttcctcatccagtagcaggttataaccaaaccggtagtcatagcggtacagtttccccagcaggtcattgatgatgatacggcaagccaaaatgacacgggttttatccacctgcatcagctggtagcgttgataattgctgtaatattcttcgtgacggcgggtattgcaggcggcatcttcaagtaaactatctactgcatcctgacaaccatcttctttttccccttccatgcagttcagaagttccatcatcaaaggaaagctctgttcatccataggagcttctgctgcaagaaaaccgatcaaagcggataagagcagccgagccgccgtctgttcttgttccgtcagcacggccattgttttctccgcatttggcaggatcttttcttccacaaaatctgccgcatcgtcggaacaaagctgacggatagaatctatggacaatgaaactgtcacggtatctaaggagaaatcaaaggggtcatcttgctttggctttctccgaagtttgtttaacatggtagaaagaatgtcgccgccaaaatacacggcgatcaccagcaggtcaaaaacagcaatcagcttgataaatataatcagaacactcatttttttcgtttcctttctttgagccagcgttccatctcacgatggcagatacctacgcagggtcttccataattcccgcaaccatagcaggggtggctgtggggtaaagaaggaggacgggaagtttccttcccgccctccggcctgcgtgtcatcatgcgttcatagggactgtctgtgaatcgggtcatttcacgctgtcctcatcatcttcttctgtgctgcccccatcagcgtccggttcgtccgactcctcatcctcggtttcccattcctcggaatcttcctcgccataatcataatcgtccagactgtcattgcccttggtcttaggcttgttcttaacaagcttcaaataggcaaatacgccaccgccaccaagcagagccagcaaaaggactagcgcagccgggttcagtccggcaggcttctctttttccggctccggtgtttctgccggaggttccggtgctttgcccgtacatttactcttatcagttacacagaccgggcaggccgtattgactgcccctgcttcacattttgttgtacagctacacacagcaggcggctcctctttgacattttccatcttccatcagtgccatcaaatccgcttcatccacctggttcagaaagtgaacagcagtctttttatcctcattcgccctgtcaatcaaaatgtaaaaataattgccagctttggtggtaacggtaataagctgcttattgcctccaaaatcatccaccagagccgcattgccatctggtgtaagtgccggtgctggttctgtttcttccacaataacattgctgtcattggtagaatcctctgccggtgccgccggtgccggttctgacccctgtgcaaaagcagggatcgtaaagccaaatgccacaaccattgtcaggcaaagggcggaaagtgttttgcaaattcgtttattcttcataagcggtaacctcctgattatttgattccgacagtgctgtatctctgccgtggttcattccaccggaaagcatagcgttcagctgtgctggagtcatgcgtaacgcacgaaccatctgaacgatttccagattctctgcctccgttttctgtgcttccagggtcttgagcttttcctgatattccgcaatcttctcacgggttttctcaatttcctggtcgatacgttcaattttgttttttgccataaccgttcactcctttccacaaagtctgttaccagttcatcaggccgtagcccttaatactttgatagttcaggtcataacttttgatcttgcaggcatcgccggaatttccctccacggtataaacacggctgccatccgtaccgatcacgatacccacatggtctgctgtcccatccaaatcccaatcaaagaaaattgcatctccgggagccagattgttatagcctcttgcaccccattgtccatgagactggaaccacggaacgccctgccactcacagcctgcaaagcgcggttcactttttcctgcctggttataacaccaggatacaaagcaggcgcaccactccacgcggctgtcaaagccataccagctccaataaggatagccgcccacattgccgacctgacgcttggccagctccaccagctgcggatttccgggacgggttccatttacgaactgcacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggcttgctggtgagtttcacattcaaaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgcctgagcgctctgctgggtgtagccttgcaagacggcagacagaaatgctgccagctcatgagggtcatggccgatcataccaaggtcatagcgatactcgtcataccctgggtggctgctttcaatgttgtcgatttcctcctgcaactggacttctctggctgcataatctgcctccactgccagcatttccgggtcatccgacggataggtggtgccggagagaacggaaccgatgctctgcgccatcatggagcaggaggacatggtattcatcagcatacaggtaatgaggaacaaaacccctgccatcaggaaacccttcttgtggcgcatgacgaatgcccctgcctgctgtgccttttcttttaccgtccttgcgacttttccggttttggacgcagcctgggcggtatttccggcagtctgaccggcgtgtttggcggcggcatactgctttttgatggcctgcttttgctgccagcgggaaagcggattgctggcaaactggggattttcctgcaaagatttctggtacagaacatttacatttgccttttccagttgacgctctgcctgtgctgctttgcggtacggcttcagcttgtggctgcgatagccctcccgcaccagataagcgccggtctccaccgcctcctcggacttgtgggcgctttccacgcccacattgtcctgctctgtttcccggatctctttgtggagcttgcccacgaccagatggacgggagcttccttgactccttgagaaactttggaaggtggctttttcttgtcctcaaaggtcagcttcgaggtcttttttccggtatccgggtcaatgaccgtctgcctgacctttttctttgggatattggcctgcgccttatctgctctggccgcagctttctccgctttacggatcggcttttccagtgcagggtcagaccgttcctcatcagtaaagcgcaggcgcggttccttattcaaaccattctcccagcatgagggaggacatcatgtagtgcagctctgcataaatggccattcccaccggatcgttgaacatacagccggacaggtaggcataaaactgtgccaccacatcggacaggatcttcgcttcggttccttccaggaccagaccagccataccttccttggcacggatggcgctccagatctcccgttggggtttttcagcagctttcggtccaccatgatgaggttgttggacagggcgttgatgccgtagtacagcgcctctttgccgttctggaataattcctgtgtggtgaacggtacaaagatagccgtagaactggtggtcagtcctcgctggatctcaatctgattgagtcccaggggcagacagctcatcagcccttcttcttgctggaagtccagcctggtcagctgacagttatacttctgggcaatggagcctgcctgaaagatgttgttgccaagctgacggggattgtccgctgtgttcagcaccagaaaggtcaaaaggaacattctctcgttgcggctctgcaaatcctgcaagagttttttcgcttcactgccgtaggtagcaaggtcagatggaaatagcgataggtaagcctttgaagttatctccagcttttcccccgcttcacaccggacatgcgactttcaccgcatccggcgttccatcaatcaaacagttttcttagtctccttagtcataccattatgagaattattcgtaagatttaggttctccaaatcaataggtttccgatttgccagaattcgcagtctgtttagcttcataagttgtgaagcgtccaatttaagagcggagagataagaacaaatagtatcctcattgactgcgtgtatcagttcgtgtactggtgcaagcaccaataccagattttcatacttgtcactgccaccattaccctttggtgttttatggtgacagtggatttctgaaacacactgaaattcctttcccgttattgcacatttcccccattgagcggagaatagtgaaatacggttgtccgcatattctgcactacggcggtatgtaggcgctctcataagctgtaacagtaaggaagtgtttatccgtaaatcgtcatggattgcacttctgcctgtcgctgtgtaggcgcatacttttcgccgcaaattcattggatttgtgcattgaacatagcttatcggataaatcggttctttggattgtgctatatatcttagctgttccgatttcccatatctttggagctccatttttgtaaggtctcgaccttcttcttttagtcggtgcgtttttcctgatttcagcctgtttttaaggactatattaacagttctgccaatatcaccgcaatcaatgctgatgtctgtggctaactgataataattctggattcccataaccattgagttaaacagccgtacttctccggcctctccacggtcttttcttggaaatttgatgttcccgacctgctttgtcaggttggccttgacctttctataggctttatcgcacatgtgcgattgaacgacatactttttcccctttttgtgcagtctgattttgaatccgagaaattcagaatagctccgtctggtgtcaacaactctcgttttctctggcgaaacatcaagacgtaagcgttctttcagccaatgcgttaccgcaatcagcgtccggtctgcctgttctttcgtcctgcaaagaatccgaaaatcatccgcatatctgacgatatacatttctttcaaccttgtattccgcattgcccgatacgcatggctttgtatcggacagcccgtcgcattttccctgtaggagtagttttccgttaccgggttgcactgccactggctttctatccaatggtcaagttcattcagaaccacatttgccagcagtggtgaaataatgccgccctgcggcgttccctttgctgggtgttctatatggccatccggcatgaggattggtgctttgagaatcctgcggattacatagagcaattctttatcccgaatattaagtgaccataactgttttatcagctttgaatggtctacattgtcaaagaagcccttaatatcaaactccacaacatagtaaagtcctgacctctgcataagcctgtagattgccgctatcgcattttcaaccgaccgattcggacggaatccatagctgttattgctaaatctggcttcgcagataggctccatgacttgcttgatacattgctgtaccaatctatcccatatacaagggattcccagaggtctggtactcccgtttggcttagggatttctttgcgtctcacgcttcttggggtgtagccgtttttacctccctttacgattctacgtaccctcgctgttacttcgtcagcggtaagtttaccaatatcagaaattttcagcttatccgtccccggtgtaaaactcccggtattggatttgatgttccgataggccaataggatattttctctcgaaagtatcacatccatcaggccgtcaaagatttctccggcttgacttctggcatacagctcatcaaaggtactctgcatatcgtagtattcagcatggcggagatactccacgtattttgtttttggtttcttctcatttggcatcaggcatcactctcctttacggcgagtgacttctttttgtcatactcgcaatcctaattgcgactaagtgctaagttgtctgtttgactgacttgaggccattcctccgttttcctctttttcgcagaaaacatcatcggttcgacctctgcttttcagcagtagtacagcagcttatatgattcgtctgcttacttcctaatggtggaagcctactgcctttcctcgttccaacaatcctatctttacatatacctttaggtctccgctttaagcctgtcagcttgaacacgcctgtaacgtgctatggtgtttcataacatcaatttttactccaccacactgattagcgattaacgctaccggcacatttctatgccgtcatggtatagacccttacattcgcggttttcgtcagtcatatttcaaacattctgaccttgggtattttgtagacctccggcctataggtagcaccgtccacctctggacagctttcgtgaggctggtatttatccagcaatccatacggctactctcagccgacttcaccgagcttctgacaagtcacatttctgttgaaatgccagtcggagtattaagggggcgtttcagggcgttaccccatcattccacctctcggattgttagttctcctaacatttgaaattttcgttcttttgttaatgcctgattttgtccttcaaccacgaaggctttgttcaggaacgagtcgcacgaatatccatatcgtaaccgctccggactgccttcttctgttcctcaatcttcattttctgaatgtcggtaagcgcacgttttatcatcttgattgcttccaccggatcaatggtctgcatgtgcatggtaagggtaaggttatcatcaatatccagcagcttcttaatcatctcgtccgtaaacttcggtgcaatcatgtcaaggtaagacacgctcccgtaaatgctgccggacttgaagcggctcggatagcggaaatcaaaccccggcggcgcaatataatccttgactgacttcccggattctgacagttccttaaaggaaaaacggaaaggctccatcgtaccctgattgaaatactcatgtaagatacggagcctttccttcccgtcaagacctctggcgtttgtgccgatattgtttaaattatgtaccacatctttctcgatgttgttcaacttgctccttgcttctttgatgcctgtgctttccacgccgaaaataatgtactttgatttgatgatgccattgttaccctttgccgactggtgctttaacatctgtgtatattcctcacgaatatcgttgaaatcatcgtcctgcaggggagtgtcgaactgctccgcaagcgcctgctcgctgacctgcctgttgaataagaataactggaatcttatggacggatcgaaatagttaatcagcttgctgtattcctccagaatatcagcctgatcctccacttccagcaagtcatagttaatatcaaaaaattccaccatttttgtataataagtgtccgccacctgacagatgccgtcccggtacatttttttgaatgtaatggttttctgtgcggtgtccggcttcgcctgttctttgctgttcccggcaaggacacgcctaagctctgacagacgtttcttttccgaaaaagtaagtcctgccttttccggtgtctgcctatttttctgcggctttggctttcccactgccgccttttgctttttcttcaaggaaacatacctccttcctgattttttcccgttcctccaactgctcgtagaggttttccgatttatacggtctgattcccggcgtgagtaccttctgccggagcatgaagtataaaatcttctctgccgggaaaccgtctttttcatacatagccaaaaagaagaatggcagcattgcacccaccatgataatcgccgccccctgtgtgcctaataccccttttgtgaggaaatataagggaacacccacaagggcagctcccgaaaaacagataatctgccttttggtaaggttcaatgctacttttgtcttgattccactcaggtcttttggcactggtactgaaattgccataaattttgctcctttcgtgggcaatgcccgccaagcacagccttctgtgcttagtgggcattgaaaattgatttgcttaaagagcctgtcttgaataagctgaaacagaggattacggtatatgccgctaccgaccataatgcgctgtgcaggttgcccgccactgcgacgcttgccaccagcacagcataaatcgccacgcataccatgataaaaaatccctgaaacgccagtgcgacaagcccctttaaatagttcgtcccgattgttccccattcccggttggtaactgtcgctgccgggattggcgctactgatacataaaggtatatttcaatcatgcgcccgtataaaatgacggtgatgaggacggacatgattttcatacacaggctgattaccatagtttccagacctaaaccgatcagctccccgatgcccattgtgtcaatctggctgttgaacatggaagtaagcgttgcttccacatcaaggcttgttgagcctgatatggaagatgccgcctgcgtcactacatggcttccaacgtcaaataccgccatgacaatatcaaaagtcttggaaagcagcatgacagcgatgcaagccttaaataaaaaacggaagaacaggcttgtatcgaagtcatgcatattgtttttgtctattaccattgtgataagctcataaatcagcacgaaactgataatcagccctgctatggggattaccacattctccgacagcgtccttaccatgctgaatatgccggagttccatgtgctgggtgtcttgctgacttccccggcaatcgtgcctaccttgtcattgacgtcggtaaacatcgtgccgaggttgtcaagcacccatccctgaagcatttcctttatgaaatcagtgattttgtcaatgattccgcccatgaagggttatctcttatgagaacagtgtggaaagctgtggaatcaccgtctgcgccacaatgataatgcccccgccgctcataagctgtttaatgccctgtgattttgcacccggattatcatttccatatccctcaagcagattgatgacgccccatacgcccacgcctgcgccgattgctgttacgactgtctttaatcctgttaccgctgttgtaaaaaatgccattgttctacctctttctttctcatcaaatgttttggtttctgaaagagtttttcgtgtaaaatgccctgccttatggtaagataaaaacagggcaatcctttgggaagaaccctgcgggcatccggcacattcagtttggcgattggctgtgccgggtgctttgttttctgtcctttcccaagtacattcaaaactccgttccacttctggactttttgtccaaaagttctgtgactggtttacaagttccatattcagttttcagtattcagttttcatgtttcaatcacgcccgcatcctccacctcatcaacggtgtcattgtccctgactttcgctttgcacaggttcttcacatatttttcgatgtctaaggcgttcttctcgtcatagtcggacaggagcttgtactgcttgtgcttcgtaatgtcaaacttattggagaagaatggtcttacccctctaagctgcatgatgcacttgcccccgtccatgaccgcaatctcatcttggctcataagctctttcccggtcttttggtagttcagaccgtaggactgcgacgtaccccttgtatccgaggtattataaaggtctattgtttctttacccaaaatttccgccatctcttttaaggtggtcttttccttccctccgaggaataaggtggtatcacaattcccttcaatcgtgtcggcgttatccttataaatcgctttaagctgcgactttgactgcaaaataatggaagctgatatttcccggctgcggattgtagcgatcagcttctcaaactttggtatctgcccgatgttgtaggctaagaatccggcgccttactgcttcacaacagcaggtttccgagtcctcgccccggaaccgcacgtacacctctcgatgtatacggctccccactatacattctctacattatttatggattctgttgtaacagtctccgcatactacaagcgtttttctttttttcttattcataatcgctccccagtctgtgttcacatcaaggtcgctcatacttttaacctgatataccttaaccgcaggcacatatgcaccgcacatctcacagacgttcgccttgtatctgaaaaacagttctttcggcttgttcatctgctcatattcgggtattacatcaacataacctccgagagcatatttcacttttcggaaaccatcgttgtaaaatactgcatacttcacgcctctctgggttttgtacggtactctgaactctttgtttttggtatatttgagctttgcttttgtcatcgtaatacggtattttgccgcaactgtcttgtacaggctgtattccataacataatggaacttattcagtacggaaacattactcgcaaggcggtaatagttataaatcccccgaatctgcgcattgtatttccgcaccatttcatgcactggcagaaatatatagtcattccgctgtaatggcttccagacttctttttctcccgcctttgacacgattttcagcacgccatagcttaacagcttacctacccatttttctttcggcaggtacagcttgattttgccagtataggctttagttgtaccttttcctctggctttcttcactgcactgtcgttacataccgtaacgtcatagccgaggaacctcgctttgtcgtcactgtttgtaatgagcgtcttttccgcagacaattccagtttcagcgtttcctcaaagaatttcccgatgtctgctttaatcttttctgcgtcctctttactgccgattacaccaataagaaaatcatcggcataccgcacatattgaatccgcttatagtttttgtccatcgggtctcccatagggattttctggaactctctttttagctctgacaggcggcgtaatgcctcctgtttttctgcgtccgagtatccgtcccattcttttcggattttattcttgcatcgttggcggtgcgactgttttctggtgtattcattattccttttcctgcccgttcccctgtcgaacttctttttataatcctccatgaatctgtcaaattcattcagatagatgttcgcaaggatagggctgataccggaaccctgggctattccactgaaagtagcgttgtattcccagttctccatatatcctgctcccagaaatttccagataagctctataaatgcttcgtcctttatcctcctgcgcaggatattgatgagattatggtggtctatcgtatcaaaatacgattttatatctccctccacaaaccatttcacaccagtaaagttctgctgtaactgtaaaagtgctgtgtggcagcttctgcccggtctgaaaccgtgggaatagttggagaacgtcggatcatagatactttccagtatcatttttacgatttcctccaccagcttgtcatcagatgatgagattccgagcggtctcattttcccgttcttttttttgatatactgcctgcggactggattcggctgatagctgtggtcttttactgcattgataatccgctccactctttctttaccatatccgtcgagtgtcagcccatctatgccgggtgtcatcgctcccttgttggcatagatgttttggagagcctgcaaataaaaatcttcgttgtaaagattcctatacagtctctcatacttgtagttttcctctttcgagtgtttctgtagattttccaaaataatctttggacttctcatagtgtctcacacacctttcctaaattatttcagtcgtatagctgtctcccttcgccatgtgtacggtattaccgcctcagactactatggagactccgtagccttgcaggatattcagacacttactgccatagcttaaaatgataagcgttcctgtttagactatcctcgtttaggcttgtctgtacaagcgtgtcatgttgtcggttacgacgttcgccattttccgcttattgcggctggtcagtgcggaatgtgatgtgtagacgcagttcgcacaactctgcgtacaccctgcactgcctgacgtataatagctatcttccgtcagtgctgacgataaagcccctctggctgtcatttaagcagtatagctgtttaacctcatacatgacgtttcatcttgatgcccgttcacagtctgatagctgactgaatagcaccgttaccgacatgctatactccccgtccggtttccctttcggataagtcggttgatgataggaattaggcttctgcgaagccctcacattgaacctactatcttgctaaagatagattacaaacaagcccgcgcggaacgaatgggttccgcttacgagcgcaccgcaaactcatcgagtaagcagcgcacatggacaggcagccttccatgatacacatcgtctgccctgtcacagagcaggttaaaaagctgcgtatacatgattgatacaatgaagttaaatgtatcgtccgtatcggagataatgacaaacagcgccgtcttttcatcccctaacatatcaagccccaactcgtcataacttgtcaggtcacgcagctccttgatgtcaaagggcgctaaacgtgcgccacagctaattaagatacttttcgctgtcttgcccgccgccagtttgtattttttatactgcttgactgcaaaatgttccggctctctttcctccagctcatcgaacatcaaatcaacagggtttttaaattcctcgtcgtcctccctcgcttcacttgcgtttatcatgtcaagcagggtggtaaagttctgttcttcctccacgcactcataccagatgtagccgatcagtgcggtatagtagagcttttcggctttcacccaaaaatcttcgccggattgctgcccctcccctttggtgtttaaaatgattgtgtttacaagtttcaaaatgtccttctcgcttcggatgtcgggtaagagactggcattactgccaacccctcccctaagaaccgtacgtgacagtttcccgtcatacggctcaagcctatcgtaaggcctcgtgtaaaacgaaacccggctcaaatcaagtagtctgtctcatgcagatttcgatgacaccagggatgtaccataatagcgggccattttctgttgttttcggtgataaaatgcctcttgaatcctgtttcggatgtaattctttctccacatacagggcagcaccgtttctggttgttccagattttaacgagtttttcccgtcctttggtactgttcagcattctttctccgtcacgttcctcataatatcccgtccacttttcatcgaacggattggcttctgcggcgattttcctgaatcgaatgattttagtgtttgccgcgtattccagcttgaggtatttttcatcgaaatccttaccgcggaaagcaggctctgttgcaaacgtccacgtccggttgtcaatgtggtgccagtatttattagcaatccatctcttgccttttcgtttgtgtctgcggcaagcccacctccataggcactcgaaaatcctgtggtcaaccaatccaaaaatatccgcagaaacaacatagcggtggtagttgacccaaccacgaatgacaggattcaacttgcaaatgagcaagtcctgtgtggctgttttgttctccctaacgatagtccgcacttttttgaggaaggattttatcgcattctttgacggcttgatgagcaatttcccgttgtattttcgaatgttctgcccaagaaaatcaaaaccatcgctgatatgcgtgattaccgttttttcctcggagagttgcaggccgcgctccgccagaaagtcctcgatgagcggcatgacttcgttgcgcaaagtttccgggcttttcccggtaacgataaagtcgtcggcatatcgcacgaagttaatctggtcgtaaacagttttacctgccaccgtccgtctcattgggaatctttcttttagaatccgctccagaccgtctagggtcatgttcatcaagactggcgatattgtgccgccctgtggggttccttcctctgttggaaagagctttttggtctccacaaagccacatttcagccacttttcgagcatttccttgtccattgggacattttccattaaccagctatggctgatatggtcaaagcaccctttaatatctccctccaaaatccattgaggggaaccggctctgcacaaatcgttaaagcattgcccgatggcatcgtgtgtgcttcttccaattctaaaaccgtaggagttcgggtctgctagagtttctgccaatggttccaatgcagacttatataacgtctgcatggcacggtctgtcatcgttggaatactcaggggacgcattttcccgtttttcttcgggatatacacccgtctgagaggttgaggcttatagccccggcgtttgagtttatcaatcgcctcgaatttgccttttggcgttttccataattcatggtctacaccagcggtatttttacctttgttgcttgtcacacgcttcacggccaacgctttggcatagaaggagtgcgtcaacagccattgcagagatttcaccttgttgtaatgaccgtctttttgagcctttacgatacgcatttgcagctttttaacataggcctccgctttcttccaatcaatggattcccagctttgtgccttgtcagcaggcgcacacagtttcctgttcatttgcgattcctcctctcaaaagttctgtaaattctctcgtaaagatagacctgctggaagtcagcccgctttcacgtgggatactgtttcagtccctatccgtcctcattacaaggccggcattcgctttttccagcgttccttacccgcgtttctatcggctttccttgcggtcagctttccgaatatacggagagagcgcgggcttaccacgtttcacgtaatcaaccgtgtaggttaggtgccgcctatccgccggcagtcttgtttgtccatgtgttcccagcttacaggagaacatccgactgcacacctttttggttcaggcttatcagcaactttagcctggttcccgctaacgacgtttaacagcgatttactcacattcaccatactacacaagccaagctccccagccggacgttgcttccagcttttcgcctctgcctcgcggtttcggcttgaccctttcgggagggctaccttttctcgccatgctgcctcacgaccgttgccagccgcttcggtgacgataggctactgctaatggaataacaggttcggtcagcgccgaacagtttaattacgcgacctcgtgtcgcgcataaacgagaggattgtagtgcatggacttcttgaagttaatggtattcagcacttttacccggtaattgttctttaagagcatttttccgcactcgactaacacagtgcctttcggatcagtgacaacatagcttgagtgcatctgcatcaggttcggttttacaaaaaacctcgtcttgcctgaaccagaaccgccgataacaaggatatttttattccttgcatacttcggctgtcttggtctgcctgacatcatcagcctttccgtttctgtaagcagcacattgttctcaaaaaccggatcgacataaggctctatatcctttgcgtttccccaccttgcagaaccgtattccattccatgccggaatttcttggcgttcttggctttgaaatacaccacaaggcggagcgcaacgccgcaccctgcccctatcaataaatcttttgggtaaaaactcggtaatgggttagaaaataagtcctccatccccgccatgaccgccatcatctttgcggaagcgtcctgccccggcgatacccgccacagccacgctatcttgtcgcagaaatatccggcaagcacataaggcaggttcataaggagaagtttctttttatccacattccccgtctttgctttgagcttttcgggaatggattttaagtctttggcaatgccttctacgattttactcataatgactgccccctgtccttctggtgttcccttgcccgctcccggtttttatccttccccaactgctcccggaactccgccagcttctcctttacggagatgcggtcatgctttttctcattaacttttacaaattccttaaatgcctgcgtaatcacgtcggcatccttgcccttgaaaaataccatgtacttcggcggtgcaactgtcttatctttcttcacagcaaaatctacgttgtatttttttgccactttctcaaaagacttgatgttgttatccgtcacctcaatgctcgaagcacccataccctgaccgaccagatctttcactgacattttcccatgtgatgcctgttttccctgtttccggtgttccagatacatcttcattgcctttttcagcacgtcggtagtcagccgggaagatttaaacacaagggcaatcgttttttgtgtcacttcctcctgcatggttttcctccttcttctttattgctgtacccccgtcagggtgggacgtacagcctgtgaatcagatatttcataaacgctcctttctgaacgggttatggcagttctgccgcccgtccttcttctaccgcttcagctatctttgcaaaactgctttccagatcgtcaaagctgaccggaatatcccacgtatttttaatataggtatccagaaagcggtaagaaagccgcccggttccattcgtcagactgacacaataaacagacgcaaactccccgttctcaagcatccatatctcgttctcaaggcacaaggtaaaattatctgacagtaattcctcaatctggcagcttatcatgcaggctggataatggaaaagctcatccgtcatggaaaacggctctttccctgtaccgtcatccccttccagtatcattacatctgtcatgttccttttgagatagaggaataactgccccgaatagttttctgccgcatactccctcggattgctcccgtcacccagaaactccgcaaggtcatcaaattcactgtccgcatataaccggaacagccggagcagcgattccctcactttttcctctgtcagcccttcttccaagtcaggcgcatccgctctgacctccgccattttcttctttttcccggctttccaagcacagaagattccgctccccgccgctgtcatcactgccgccgcagagagcattatttttacttttttcttttccatccttttctccttttctcttttggactttttgtccagaagttatataaacgcaaaaaaggcagctacaaaccgatattatcggtctataactgcccttacgctgtttcccatattcaatttatttgtaccggattactggacactgcttcgtctttttccctacttttctgcgttccagagcaaaaaccatatccccggtacgctcaaaatagcctatatccttcttccagctcataccgcatttacagtgctgcaagccgataaactgctgcttcattttcctgccgcagttcgggcatacctttttgctcatgcctttccgcttcacttttggcttatccgcatcatctttcttcttttctttcttttcgggaatcccgttctccgctatccgcacttcatagcatggtagccggtaaagatacaggctgtatatttcatcaaaggaagccttttccgctatcccctttactctctggtagatttgccccgcaattctttcacagtcctctccttctggcagcttgccatgctccctgtaataatcacaggtcttttcaaacatactgtccgctatcttcgctttctgtttctgctttaagtctttatatgtcctgtccgcccttttcagccgcttcctgttccccaaacacaccactcttgcctttatccctgatacggtctattctaacagaaaacgctccgggattgtaaaaatatctcccttcctgaaaagcgcttccattaattactctataaattggaatttattttaagctatcacgttttacctttttaagccttactatcattaccataggaatttctttgttgtttttgaaacattcttcataaaatccatcaatgacaaatccagctctaaagcaaaggttaaaaatatcttgtatggaacgatgataataaatctgctcctccggttgcccttcaatcgctatatcatagtaactgtgcggtgtcatatatttttcagtcaacgtgataaaacaagggtgttgcgttgcaaagacaaaaattccgctttcctccaacagttcataaacagtcataagaagtggttcgatatccgtaatatccataattgccatattagaaactgcttttgtaaaggcccgatttctttttaattctaatatactttctctattggtcgcatccgctacacaaaattcaatttgttttgcatattgtgattgccgtcttttagccaattctatcatttttttgctgtaatcaaaagcgacaatcgaagcgcctctttgtgcaagatacgaagaataatttccattgccacacgcaatatccaaaatgtaatccgcaggattaggagatagaagttccgttactttgggacgtactacctctctgtgaaattcattagatttgtcacccattgcattatcccaaaattgtgcgtttttctcccagatttttttactttcctctgttcccatgttctctccttcccccaaattttccttttcgcttcaattaaatcattctttgtatattccatttttgtcctcctcaaataccgatttgtcagcatcattataacttgtttttagcgggaacacaactccgagagagagaaacatatctgctaattaactgaaaacgtctttgcaccgggcaaggaaatacttctttttctccgttatttccttctgcctgtctttggaaagcgtctggaatatctcgtcatagtcaagctccgcaagcggtgttcccaacacaggcgttaagacttcatgttcataccatatccgccacagttcctcaaacagttccctgctgtccgaaaaagccattgccgaatcaaagccttctccctcgctgaaccattgcagacggacaaacccgaaccgcccggcatccgcaaccaccacatcggtcagctcatacagttctgcgaacgcatccgcaaccttccggcatcctgcccgctgttcttccgtaatatatttttctgccatagacgctcctcctaatccacttctggacaaaaagtccaaaagttatctattttattttaaacagtaaatcgtgcagaggtcagcatataacataccctccccgcattttatcgtgtcaaacaaaaggcactgaaacagtacatcacgcactccctccagactgacaatgccccgttctttctctgaaaagcctgtgcttggaatatccatatcctccggcactgcccgccttgccgagatacagtgcgtgtaaagtccgaggatatatttatctgacataggcaaaacgaatgtttcctgcccgtcatacgttacctggtacttttcccgttccccttccggcagctcaaagcagcaccgcactgtttccagataagtatgcccgtcaaaatccggctttattttcttcccatacctgcggattgcggaaaatatgttattccggtcaataaaagaacgggtacgcttgaaagctgcttctctgcctttcatatccatgtaaacattattccccgtccctttcccggcaaacctgccataatcgccagttcgcaacaggtaggacagcacctctaacagcttttcccttgatgcaatctcctgataaggggaatcgctaaattctatcttcacaaaccttaatgggcagcttccctttgctatctcccgttccattgcccggtcaatatccctcatagattccatttatccatctccttcctctttagactggaacattcctttttcttcccaccctccgccatacatatcatgctgtactagctgctggtaatagtgattcatggtattgggcgcattgtagagtgcagtcaccatgtatgccctgatattggttatcttggttgtggtttccttcatgcacccaatgacatactccaaatgggagctgttcagcttcaggaactttgattttacaagctcataagggtaatcttccccgttgacctttaccgtcctgcgctttacgcacataatctcgcagatcacctcataaagttcctcatacagccccttttcgctccagtcaccgtatttcatgtgatgctcatactcaatattttccttgatgatttccatgtaggcagtagcatcatccatcgcatcaatcatatcatcatccagcttgccttgcttggctttttctatctcctgattggattgattgataggattgttataactcaaatcagtataattagtattgttataattagggttcgattcccgaacttccgcaagttcggtttccgaacctcttgaagtttgatttccgaactcctgcaagttcggtttccgaatctcttgaagttcgatttccgaacttcttgaagtttgattatcgaacctcttgaagttcggtttccgaacttctgcggaactgtcagcaatatcaggcttttccggctctctgcccggctcttttgcggcatccagtgttgcgaaattcttcacatagataatgtccggcttgcctaatccctgccttttcttctcaattagaccaatgccttttttgctgtcaagctccgcaatcacctttgcacatttttcccttgcacatcccaaatcctccattatgttgtcaagtgtgtaatggatatacacccggttttcttcgtcaagccagccattcttgattgataatgccagcctgtcaagcatcagaccataaaggagctttgcatcgctggacaactctttaaaccttgtgtcttttatcagcagtcttggaactctgtaaaaggaaaattgttccgcttcgatgccataataatagtcaaattttatcgtgccatccacgctgatgcacctcccctctattgttttttcttccactcatccaatagctgaatgatgatgccctctatttcctcactgctgtaatcctccgcaaaatattcgctgattttatccgctttcagtgtcaccttgcgttctttcggcttttcctccgtcagtatcaggcgcaccatcgcaagggtaagctccccggtcttgccatattccttgatttttgccgactgtaccatgctgatattgcagcttttttcctctatgacagcctgtacccattgctgcgcttcctccgtcagaaaagaaatatccaccccctgtgaaaagccgagttttttactgtctaccatagcaagaagttcttccgacagccgggaaagccagatataccgctgaaccttttttgcattttccccggcagcttccccgacttcatcaagggtgtttttccctgacttttttccctgatgcttcatcgcttcgtacttcatcttataggctcttgccttctcgcttggtaagatgtcctccctctgaatgttggaatccaccatgataatcgtcgcctcatcatcggtgtaattacggacaatcacaggcatttccttctttccggcaagctctgaaccacgtttccggcggtgtccggctatgatttcatagccgccgccctccctcggtcttgcaatgcccggaacaagcaccccgtactggcggatactctccgttgtttcctccatcttctcatcatcttccacccggaaagggtggtctttgaacgtatgcaggtctgtaagaggtgcgttgataatctgctctgcggagctttcctgttccgcagaaccgccgaataaatcctcaaatttatctatcctgacttttgatgcgcttccagctctcttattactgcccatctgcaagcacctcctttgtcagagaatcataagccgccgctactttcccttttggatcatgcttataaatgctgacgccttccgccgaaatctctgccgcccttaccgaaatggggataatatttgtaaatatccttacgctgcttccataggcatccttcagcatggagctgatgtcctttgcatagttcgtccggctgtccaccattgtcagcaatatgccctcaatctccagtttcgggttcatcttccgctttaccttgccaaccgtcttaatgagctgctgtaagcctttgacgggcagatacgccgcctgtacgggtatcaaaatgctgtcggcacaggcaagggcatttatggtaatcataccgagcgaaggcatacagtctatcaggatataatcgtaattctccctgactatctctatgtatgacctcaatatcatttcccggctcataacattcacaagggaaacttccagaccggacaattcaatgttccccggcataaggtctatcccttcctcgtggtgcaggataccttctgtcggctctacttcttcatcattgattaaatcccccataatggttgcaagcgtgacttccagagtatccggctctgtatatcctaaactcgctgtcagactgccctgtgcgtccgcatcaatcagcagcactttttttccctgttttgccagtcctatccctaaattgcttgtggtggtagtcttgccgacaccgcctttttggtttgcgattgcgattattttacacatgattccattctcctttgcaatctactgttcttcttttacattgcttttcttaacttccacataagcccggtaatatttctttgttcccttatttgagaacaagtcggaaaactctgttacctcaattttgggatttctccgcaaaatcttaccgaaccagttaatatcattccttgttcccattagcctgacttttaacatcaatcctgtcctccaaacatggcgtacagactgtggttataggttgcgtactccggatacctgatctgtatcgcctgccaaaaatagggtgcataagcacagcagaacaattcttccactgtgtaaagtctgcactcgtctacctgttcctccgcatcatcataatcaaggacactcggcgtaccattgcaataaaggttgaacgccatcctgactacttttacactcccgctggtctgccagccttcatgcaggcattccgtttttacacagcctgtcttaaaatcataaatgcttttaatgttccttcttgtgtcattgctgataccaagacaatatacaagtgctttgtggtacacgtcctgatacctgacctctttcaatttctcatagtagaatttctcatgtccatcactgataaaaataatctttttcgctttctctgctcctaacgctgtactactcattcttttttcctcctgttttgaaattgaaaaggcactccattattggaatgccctaatataaaaaatagggacactctcattcaagtatccctataatctatcaatatatctgatagtccactattcactttcattgtcaggattttttgtgttccccgtatcgaggtctaatgccacaactacggttactttcttcacaagtatcttttccttatgattttcacagattttattgaaactgaaaaatgtcacaaagtgcgtaaattcaaggatttctaggtatcttttctttgtatcaacaccacagtctcaactgttgtttcgttgtcccaactaagttcctgaatttcttcaccgtcaaaaaataccggaaacttaaattttatatgcttcaaaaatcttccgttcggctgttcatcctcgtaaatatcaactctttcaacaaaactgttcataaattcttttttctccatatcggtgaatttatcatacagtttgtcaaagtacaaaagatattgatacactccatcctcagaaattttctgctgacggatatactcttttctggatactatatcatcgatcagactttccagtcgttcaatctcatcatacaaaccatttaaccgatcctgcatatcctgatacttcctgtcatacattttatcagaaatatccagattgtccatctgttgtcctaacctatttttagctcccaatacttgccgcagctgttttttcaagttctcatgctctgtttccaattctccggtatctatcttagaattgatttttgcacgtatagcggcttcaaatttcggattattcaccagctttttaataacttctgctaccgcatcatttactttttcttcgttccactgcttccggtaatcacatttatgaccattcacataatacctatgcttgcaggcataataaaaataatccttataaaatgttccgtcttttttcttcttacggtttacatttccatacattccctttccacaaattggacatttaagaattccggacaaaatatgttcatgctccaaactatggattttctcatgctttactccatttatatttcgtttctgttttgccaagttccaatcatcttcggaaataatggcttcgtgaataccatcacttaatatataagaatcctgctttacaatacggaattcatttctcttgcctggcactctttcagttttccttcttccaaatgccaatttaccacaataaataggattatcaaggacaccctttataaaagaagtagcaaacgcatccaacgtattattctgtctctttttcttcttgtagccatgctcattcagataggctgcaatgccatttactcccatattggtatgaatatatttatcaaaaataatacgaatgatttctgcctcatcttctgcaatttccagttctccatttaacagcttatatccgtacggagcaaatccgccgttccatttgccatctctcgccttttgtctgcgcccctccattgtctgtaccagaatattttcacgttcaatttctgctaccgcagacagaacagaaatcatcagcttaccgctgtctttagaactgtctataccatcttcaacacagatcaaatttactccaaaatcctgcattctctgcaaagaattaagtacatctgcagcatttcttccaaaacgggataacttatataccaagacaaactctacacgatctttaccttcttcaatatcccgaagcatttgcataaattcctgccgtccttcaatactttttcctgactttccctcatccgaatactctccgacaatcaccatttcctgaaaatctgcatattttctcaatctttctttttgtgcttccaagctgtatccttctacctgcatagacgtagatacccttgtgtatatataacatcttcgctttttcatttatattctccataccaaattacagtttactttttatttgtcccaactatattttaccgtagctgcacatactcgtcaatataggtaaaatgcacaaatatcacgcaagaaaaaagagagccaacatctatgctctccctaatcatttcccaatgtattctgttgctgctcttgctggcagttatcttctgctttgtcctccttcggtaatccattcagttcctgaaggagctcactgccatatttttctatcattctggcaagaaaatcaacacatcgttcaaattcaactgtgtgtgccatagctcctccttccaaaccgatatttcttgtcaccacgcatttttcggcggtactctttagctgatctggaatttgtgctataatttctattagaccaactccgttcagcctgatgtcagtttaatggaatttcataagaaactcattgagcatagattgagcggaaattgagtattttacagaacaggaggggattctatttggaaagatgtgattttggttcgattatgacgatcattcgccgttatatcagcgaagataaaggaatgaatcaaatagattttacctatctgttatttgacacgtttatgtgcagcgatgaagccatagactttgattttgacaatggacaggtctgccgttggatgacaggacaggcaaaagtaagtccccggatcgtaacctactttttagataaagaacatcaattagaattggcaggaaacattcagcgacatattattcctctgatgtatgattctgctatggcagcaaaagaattatatgagttagtattacaggatacatctatttcagagccaaaaaaacaggaactaatctgttcttattctcccgctgatatagacaccatacatattttcataacaagggttctgtgtttcggaatggaacggaattttgtgaaacgtgacacacgaaccaagaaattattagccgccggaaatctttctcctgtcttaacagattttgtaatgggaaatgacgttccccgtccatgcaggcatttttgtggacgttctgaagaaatcgaagtgctgcattctctgttggaaaaagagcgtaaagtatttttatctggaattgccggaatcgggaaaagtgaactggcaaaggcttatgccctgcagtataagaaagaatataccaatatcctgtatctcacctacagcggtgatttaaaacaggatattacagacatggattttgcggatgatcttccgcaggattctgatgaagaacgcttccgaaaacacaaccgttttctgcgttctctcaaagaagatactttgatgattgtagataatttcaacgccacttccatacaggacagttttctttcggtcatactcaaataccgctgtcagatattatttactaccagaagccgtctggacggacattcctgtatgctgttggaagaaatttccgataaaacaacgcttctgcaacttgcaggaaaatttttctccgacacagaagaaaaatctgatgtcatagaacagatcatagaagctgtccatgcccatacgctcgctgtagaactggcatcacgcttactggaaaccggaatattggaaccagaaatgctcttaaaaaaattgttggaagaaaatgtcgctcttgatgcaactgataaaatcaatattataaaagacgggcaaagcagcaaagaaacctactatggacacatacatactttattctctctatatcagctttctgaaactcaacaagatgtaatgagatgtctgtgcctgattcctttaaccggtattccggcacgaagatttgctgcatggctgaatttaccggatttgaatgccgtaaatgatttaattgaaatgggatttattcagccaaaaaccggaagaaccattgtactgcatcccatgatacaggaaatcgctgttgcagatatgcagccgtctgtaaaaacctgtttccctttactggaaagtctgcaaaacatctgccttttacacggcaatgatatttcctactacagacttgttttccaaaccgttgaaaacattattacaaaaacaactaaagatgatatttctggttatttattattcttagaagatgttttcccatatatggaaaaataccacgaagaaaatggtatgcaaagaatcctgcgtgaactatcttctttgctggaagacacttctatcggaaccgtgtctgaccgggcattattactggactataaagctacccttgaaagaaatattggaaaagccgtaaagctggaaaaagaagcgatgtctttgctttctcctgttacacctgaaaacgcccacctcgtcgcaaatctatatggaaatctgggtggactatatcaccagcagggaaataccgaactggcaaaacaggctatggagcagggaatcagcttattagaacaataccagcttctctatatgaatgacagtattgttcaaatctgcaactatgcagctctccttacagataccggtgaagcgtctcgtggattatcctccttacgcaaatgtgcccggctggtaaaagaatacaattccgatcagtatctggactatgccattattcaggaagctatgggaactgcctatctggtacaggctgatatagaacaggctacctcccatctcaaaaaagctatggcaatctatgaaatagtatgggaatctgaaccggaagctatcgataataaataccaacaaatacaagaattgtatatcaatgctggaatacaaattggacaacaattattgagctctactaaaaatgtctgaatagtctacaaatcaaactattcagacattaaaacttataacaatatgaatattttatattaattagtcggcaataaatttcccatactcttcaaactgatagctaaagtagaagtattatgtagtaacgcagaggtcgttggttgaataattcctgccactcctagtgcaatcagcattgcattaataccgacaatccccctgtaattcccctgaatacggtgcatcatcgcattagacaaacgtttcagtactacgatttcccgcagatcctcagcagcaatcgtaatgtctgcgatctctcgcgcaagttctgctccatcactgattgcaattcccgcatctgctgctgaaagcgctggcgaatcattgattccgtcaccgatcatcactacttttcttcctgccgctttctctctttcaatgaatcctgccttatcttccggaagtacttcggaataatattcatccactcccactcgtttcgcaatagatgctgcagtacgttcactgtctcccgtcatcatgacgatcttggaaacaccttcttctttcaaaaatcttaccatctccccggcttcttccctgagaggatcttcaatacagattacagcaactaattctccgtcaatggcaaggaacaaatgagagtattcttcaggaagcgtatcaaatcgttcctgatattccggacgtatccggcacttttcatcctcaaacacaaaatgactgctccctattatggtcttctttccttctatataggaggaaataccatgggctacaatatactccacttttgaatgcatttcttcatgatacagacttcttctctttgcagcatccacgacagcttttgccatggaatgtggaaagtgttcttccagacaggcagcaatccgcagagcttccggttcaggataatcgccaaacacaatgacttcttttacagttggtttcgcctttgtcagcgtaccggtcttatcaaatacgatggtatctgcctctgccacagcctccagatacttcccaccctttacggtaattccattctgtccggcttcccgtattgcagaaaggacagaaatcggcatagccagcttcaatgcgcaggaaaaatccaccataagaacagaaagagcttttgtcatattgcgtgtgacagcccagacaagccctgtccccagaagcgtatatggtaccagacggtccgccagatgctctgccttgctttccagattggatttcaacttttctgagtcttcaatcatagtcacaatcttttcaaaccgggtagcacctgatacggccctgactatgatttccaactctccttcctccaaaacggttcctgcatatacggactgaccctcagttcttcgtaccggaagagattctccggtcaaagatgcctggttcaccattccttctccgcaagacacctctccatcaaatgggattacattgcccatgtgtacgatcactctgtcacccggcaaaatatcggatgccggaacaagaatttcctgctcctctcttttcagccatactttctttatgtttaaagacatgctgcgtgccagatctcctacagactttttatgtgtccattcctccagcaattctccaattcccagcagaaacatgacagaaccggcagtattaaagtctcctcgcagcacggacacgccaatcgctgtagcatctaataccggcacctctatcttccgtctggccagacatcgaatcccttttccgatatattggaccactttaaaagtaagccatatttttctcaccgaatttggcaagagcaatttccctccataatggagcaatgtttttgctatcagcttttccctgtatgcggaatttaaagcacgccctgaacttgataatacattatccggaacatctgctttctcaaaatgaaacttttttaatttatggatcagttcttctctgtcccctgtataatagatcacagcatctgcggtgcgctcatatactttgacctttataacacttttctgtttttcaagagcccagcaaagaacatccgcctccgtacatgtcattcggtttcggataacgtggatacggagacggccctgtacttcatgcttgataagaaatctcatcttttacctattcgttttcttcctgttcagacgcaccatcctcctgaacatcatcttcctgcacctgcattgcctcttcctgtgcacgcttttcattgatctgttgtgcttctgcaaggatatcctctgcgttctcctgcactgttgtagcagtcttcataacacagtcttttgcccgcagtacagccgcagtgcagtttgtatatactttttttgcgtccttactggaaaggagctttacacccgcagtcccaaatacgactcctcctacaaaacatccgatttttttcaaagtagaatcactaaacatcctatgtacctcctgattatttgtgtttatagcctgtatagaataccatcaaaaagcaaaagacggacgcccacgcccaaaacctatgttgtttcacaaccacatcacttccttttctataagactctgtttattttttcatagtaacaactttcatttaagatagtcaattctaacagtccttattgataaattttgtcatttgcaggctacttatatacgatttctctgctaagcaccccgatattctccaattcctttaccagacggtaaacggttgccatcccaatgctctggtcaagtttcaccacccgggcataaatttccttgcagctggaacacctgtcttccaggataatatctaaaatcattttacgctgctttgtaattctgcagccattttctttcagttttataataatactttctttttcaccgttcatacccgctttctcccatatgaaataccacggtctagctttgaatagactcaactaaaaaccctgctttttctactgcgcagatcaggatatcttcccctatttcacgatcaagggatatctcagcacaacttttattaagatctactctggcggagactccatcaatccgattcaagctatctgtcacactttgtacacaatgttcacaatgcattcctgtaataaacatggttttctttgcgatgaccggacccgtcaatttcttttttttctttttatttttgctgctgcaatttcctcccgctggacatccaacacatttcactccgcttctttttgccttaataagatatgcagctgcactccctactaagattacaataacaagaactgctatcatattttccatagagcatttcacatccttttctaataaaaatggtggacaaagtacttcttctctgtccaccgtctgctataacttttatcctttatgattttacagaatgcaggctgtattctgaagcaaactctttatctgacttacggattctccagagaataatcaaagcaaatacaataaccgcgataagtcccggaataaatgcggtgccaaaagatcctgttgtgatcaatgtaccaatctgatatacaccaaaagctacggtataccccgttgcaagttggagacagattcctccaagcagccattttccactcttcatttctgaattcatcgctccaagagctgcaaaacaaggtggtgtgtaaaggttaaacatcaaataagcaagagctgctacctttgtcagtcccataacagttgctacttcattcccacttccaaccaacgccagttcatctgtatctattaagtttgtgataccgtaaactactgcaagcgtcccaactacgttttcttttgcgataaaacctgtcactgccgctgctgcaagctgccacactccaaatccaagcggtatgaacaaaatcgcaaacggatgggcaatggatgccaaaatagatgtcccttctgcaccttcttctacaagctggaactgccagttaaagctctgcatgatctgtaccaccgtattgcataccagaatgatcgttcctgcttttacgatatatgcttttcctcgctccagcatagagccgcatgcccttttcaagcttggaaacttatattccggaagttcaataataaagaaagattttctgtatttttgtcctgtaatctttttcacaagtaaagctccaagcaaaactaagagaatacccaccagatacatagttgctgaaacccaccatgcgtccgcaaagaatgcacctgcaaaaagagcaatcactgggattttagctccacatggcataaatggtgtaagcatcgctgtggtacgacgttctctttcgttacggattgtacggcaagccataacgcccggaatcgcacatcctgtaccaatgaccataggaatgacagatttaccggaaagccctactctcttaaaaatcggatccagaactactgtagctcttgccatgtatccacaatcttccaataatgcaattaagaagtacatgaccataacaagcggaaggaaaccgacaactgcaccaacgccaccgatgataccatctacaaggagtgcatacagaagcgggtttgcattttccatcagtccgccgacccatccctggaaagtctcgatccatgccaccagccagtctgcgatccaggtaccgagcgttgtctgggatatgtagaacacaaggaagataactgctgcgaaaatcggtataccgataatcttatgtgtgatgataccgtcaatcttatcctgtacgtttctatcctttgtaaaaacttttctcttctctacctgctttacaattccattcacaaactcaaaacgctttctgtcagccgcttctactgccgttttatctttgaaatcaatatccccctgcacataaggtgctttctgaccttttcctcttaatgcagccgcagcatttacagtctctttgagtccttcatgtccggaagaagtggaaatcgtcttgattaccggacagcccagcttttcagacagaatcttctcgtcaatttttgtctgtttcttattaacgatatcgctcttattcagtgcgacaactactggaatcccaagttccagaagctgtgtggtaaaaaacaggcttctgctcagattcgtagcatccacgatattgatgatcacatccggattctcattcttgacgtatccgctggtaatgctttcttccgatgtaaaaggagacatagaataagcgcccggcaaatctaccgcaactaactcctccgtcccgtcataataacctttcttgatcggactttcttttctttcgaccgtaacgcctgcccagttcccgacacgttcattcctgccggtaagtgcattgtacatggtcgtctttccactgttgggatttcctgcaaaagcaatcctcataattctcctccttttcgacgtctttaattatacgcatcttatctttattagtatgcactaacctttgtgcaaaaaaaaatagtggaaactactatttttttattatattgaaatggctttcgccagatcagtatcaatattataacgcccatccttaatggaaactacacagccacccttcagatgagaaaccactgtaattggttcaccactgtaacagccaagagaaaacagaaaagaggtcagttcttcatcatctgtcaaaatttccttaatgatatattcttccccttctttggcttctgttaaattcatatccactcgctccttatagtcatttttacaattatacttaaaatttactcacagctattcgatgttttttctcatttgacgttgttagtatattctaatcccggtgagttgtcaataattatttaatacttttttatttttcttttataaatatatctggctgaataccatgaatcatgatacaataactatacaatttttataaaagaatccgaatgatataggaggtgacaagctatgcacataaattcgtctggtgaaaactatctggaaactattttaatattaagcaaaaaacgtcctgttgttcgttctgtggacatcgctacagaattagactttaaaaacccagcgtaagtgtggctatgaagaaactgcgtacaagcggacatataacggtatctccggaaggatatattaatttaactgaatctggaaaagaaatagctacacagatttatgaacgccatgttcttctttcttcctggctagaacgtcttggtgttgatccggatattgccgcacaagatgcatgcaggatagaacatgtcattagttctgaaagttttgaagccctcaaaaagcatatcaaataactctcttctcactataaattgaatggcattttaaaaccgggaatttcatactttcccggtttctaaaatcttttcattttccatatttagtattgcattattgatttttatcgtgcttcttatatcgaatatgcccaacaatacctgcagcaaagaagagtattgcggctaaaagttgcatgcttaccacaaaatcaaccccatcttttctgaaactgtcaaaaaagttagtcagccatattactgcgcctacaaaccacaataaataccatcgttttcttttgcttttcataacttttttaccaccacacaaatccaacctttttttgttttatctacttttactcctctaaaaccggcatcctccaaagatttttctatttgctcagaattgtaaatcttcatcccctgtattatcttcgtccacttttcatcctttggattttcaccgtttgattcattgcagatcataaacgttccgccgattttcaaaattttatataccttcttaaaagcctcactaatatccggccagaaatatattgtttcaaatgcagtaattacatcgaaagtttcacctctgaaagggagtttcatgacatccccctgcaggatttcacaacgcttactttctatccctgctttattgatttttttgcttttttctacactgatttctgaatgatcaatgccaaccactctgccatacggacttttttctaataactttctgacatttgccccaccgccacatccaatatccagacatacattatcgctttgaatttccatatgtgtaaatccccattcagccatagatgaatgaccagtattcatcatatgaaccataattttgccgccgattccttttggcttacaagtattttgaaaaaaagacataacctatacctctatcaactcaccaaaacaatatctattcttaatatataaaaaaatttcgctacatacagatacttccaagaatctcctgtaacgcatttttgctacttgaatggcatctcactacatccgcattgcagcgttccgcctcctccactgcacacctggccatcttatgggaaaccgtattcgtgaacagtacaatcaaatctggattcccaatctgtttacttaaagttgcagacatctgtgtaaagactttcgctttacaattaaaacttttacaaacttttttgtactgacagaccattctatcatgcccgcctataataacaacactcatacccaacctcccatttttaatatattcataaaacgctccgatagcagatatctacaaaatcatccgttcttgatcatcggttgcgttctaaatcgtattatgggaacgctgctattaactgattaaaatcttttctcgcagcattccccaatatttattaatccagattttcacccaacgctttgcaggattgaatcccctcatcatcgggcatttcattgcagatcacgctttcacaaatcaagacagctcccgcctctttgcatcttgtctcccagtctctcatccactctccatctccccagccataagagccaaacagtgcaattctttttcctgaaagttttgattcacaagaagcaaacatcggttcaaattcctcttcttccaatacttctgctcccattgccgggcatccaaaagcgatcgcatcataagaatccatcatagaaacatcaaattcatccggagttaataatacaacctctgcccccttctccttcgcgccctccagtactgcctttgccatggcttctgtatttcctgtgccactccaataaactactgcaattttactcatgatttttaccttcctttctgaagtttgtgattatatagtaatcgtaagctgttcaacagccacgccacttttccatctcctgcaataaatttctgtgcattttttatattttttaaacagaatcctcgcggcctgttcatccccgtacaccttccaacacccagaacatttgctgcaggccgccttattctcaataaatccttttacatcctctgccggataccctaagaataaacctatttcatgcggaaagtctgggtcactctgcagtttttgaatcagtctgcagatgcactgtgatagattcgtacaatcatatcccttacatttcaatatgatctgagttttctcatcagaaaaatcttcttttaacttttctggacgatagacataaaccagcatccgtttgtctgatatgcgaaccgggataatccggatccctttctgtgtcagtttttgattaaattcacgtatttcttttataatcatcttttgtgaactataagggcatgaaaaaagacttcccgttttcagtcctgctaacgtaggtgaacaatggcatactaacatttcctctgacattttctttcacttctccttaaacatcttttctgaaaatgaatctactctacccagtaagttttctttatcaatagttagttttaactaattcatgtgaaaaaaatatgcacaccttgctttcattaaaaacatcagatgtacgtttctataattttataaacctatcccattatctaaacataagccgttttttaattagctttaactaactttagtttactttattttttcactgttgtcaatccataaatagatgtgattaataaataatatttactaacctgattatacacccgttttttcgttgtaactattcctgtttatatttgaaagttcattgtaactcaattctcactcaatcccggctcaatgccattcccccttcttttcaataaactaatcctgtgcgaaacatccgcacaaaagattatcggaaaggaggatttttatgaaaacacaaagaggaagtcctgttacagatgaaaaatactgcaatagataagtgttcgtcatctgaggggaggtgagtgcatgacaacctttcttactgcaaacagtactctaccgccatatatggcatttcccagttttcttctggactgtgatttctccgaaaccacaaaactgctctatatggtgcttttaaaccgggcaagattatcacaaaaaaatgacggctggattgataaaaaaggtcatgtgttctcctatttcaccattgaagatatggcagcaacacttcgcaaaagccagacaaccatcaaaacatctctgagtgctttggaacaagtagaccttatctgtcgtgctcgtcagggaaccgggaatcccaaccggatttatgtaaaagtcccggctgatttttcaacacagacagaagaaaaactgtctgttagacagtcagaaaaccgtccctttgacagacagaattctgtccgccagacagtcagaaaactgtcccctaataataaagagaagaaaaataatgattcagtaaaacgccattatgaatgtaaggaggatgaaagcctatgataaaaccacaaaacctactgccgaacctttctccccggcagcctttagaagatgaatatatcagcgaaacggacggtctgatctactgttccaagtgccacaccccacggcagaaaaagatagaatttttaggaaaaatcatgtttccgatcatccgctgccaatgccagcaggaacaatatgaaaaagaagaagcaaaacgaaaacaccaggaatttctagaacacatctcccggctgaaatccagcggtctgcaagacccggctttaagagaattcacttttgctcacgataacggtatcaacccggaaattgaaaaggcaaaaaattatgttactcactgggaggaaataaaatccaaggccatggggctgctgctctggggtgatgtcggcactgggaaatccttttttgcaggctgtgttgcaaacgctctgctagataaaggggttcccgtactcatgacgaacttcgccaaaatcttaaattctctgaccggaatatatccgcaggatcggaatgaatttatcaatagtttaaatcagtacagcctgctgatcattgatgatttgggtgtggaacgaaattccgaatttgctttagaacaggtcttccatgtaatcgacagccgttaccgcagtatgaaacctatgatcattacaacaaatctgacgttggaagaattaaaacatccggaagatttagcacacagcaggatctatgaccggattctggagcgttgtgtcccactaaagatcaacaaccagaatatccgggaactgaacgctgtagctaatatgtcagaagcccgaaaactacttgcttaaaaatctgaccggaaacggtcatagaagaaaggaggccaatatgacagataaaaaaacacaaacagaaatcagaaaagaattattacaggcaagacacagagcagaggaagcacaggcacggaaccgtgtgaaagagcgaaatgcccggacacgcaggctgattcaggagggtgccgttttggagagcatcttcccggaattccagacaatggagccgtcgcagatcagacaggaattgttaaaccgtttcaaaagaatctgacactagttgacaccagcaatttctcatcccgaagggcgcatttactcaccacctgataaatcaggcagtggtatccccttcggggctcgtgcgctctgccgagggctttatccgctgttgcaggcaacatcgaaaggaggtgccagatatggcaatttatcatatgcaagccaaagtcgtcagccgcggttccggtcggtctgctgttgctgcttctgcttatatgagctgtagccgcatgtacaatgattatgacggcatccagcatgactataccagaaagcaggggctgatctatcaggaggtgatgcttcctccaatggctccattggaatggaatgaccgggaacaactctggaatgctgtggaagaaaacgaaaagaccaaagacagccgacttgcaagagaatttgttgtcgcactccccgttgagttggataaagacagcaatatttctcttcttcaagattttattaaaaaaaattttgtagatatggggatgtgtgctgattttgccattcacgatacagatggtcacaatccccatgcacacattcttcttactgtccgaccattaaatgaaaatggaacatggcagtataaaacagaaaaagaatatctctgtatcaaagatggggaagaaaaagggtttactgcttctgaatttaaaactgctcagaaacagggatgggaaaagcaatatcgctataaagttgggaaaaagaaagaatatctgacttcttctgttgcacaggaaaaaggatatgaacgaattgataaacaccccaagagcagccgatatggcagacagaatcctatttcccaacaatggaacagtgatgaacaactttgtatctggcgggcaaactgggcagatgccgtaaataaaatgcttgcacgtaatcagataaatgctaccattgatcaccgcagctttgcagatcagggaatcaccgaacagccaaccatccatgaaggctacattgcccagaatatggaaaagaaaggcatgatagcagaccgctgtgaaatcaaccgtcagattcgtgcggataacaaaatgctccgagaattaaaagcaaaggtagcaaaactggctgaagctgtagaaaagtctattccaataatagctgaaacgttagaagcgatccgcaatcatatgatttttatacagtatcatttacttcataatgagatgcaaaaagaagtgatccatgactggatgaatcatttcaatccaatactgaataaatacaacacagttaaaaaggaactcaaagctaaagttacggaacggaaagaactgaatgtgcaaaaggataaaaccagtattttgaatcccatccggcatataaaattaaatcagcagcttaccactattaccgaagaaatcgaagaactgaaatcaaggaaagagcagctaatcttccaggcagaatgctctaccaataaagatatgacgaatctatccaagaaatatgaccagatgaataaaaatctggatatcctgtattctcaggacacctcgctcaaaaagcagcttgaaaaagacgccgccgctttccgggaagaaaaatttcgtcctgaaccagaacagtatacagaattgctggacacccgaatccagatacgtcctgattttcgggataagctgatcgaacagctcaaaggtacttttggtaagtattatgactatcaccgccgtgatattgcagccaatgaggtagattatctcaatgtggaagatcctgatgttttttcccatcgtgcctgggaacttgaatatcagaggaaacaggaaatacggcgaaatcagcctgctcgaactaagaaaaggtcgtatgatatggaattataatttggttcttctttgcccattataaacacaagagctgaacaaataggatttttcgtcctacctgttcagccctttgtttacctgtaaatcaattctttcaacacaatctcttctgcagcattccggacattatttaccgctctaacccattccatctggtcacgagctttcaattcttccgtaatgccctgcttctccatcatctgactcaccagaatatccattttctcctgtgtttcatcgtccaccgcattcagatgttctgtcaatctgtcttccaacatatacagtgaatacattgccggacgatgctctttcagatatgttttccgcaacattccgtatttcccataatgcggttcttcatctgtactgacaagattcggatagtaaattccgtctgcgccaagtgtgtaggttccacccattttttcaaatgtgcttttcatgtgttattcctccttgaaatcagcgatgtccttagatcatcgcataatatttcagggcagccttgatagcatcttctttctctttcgggcattgtggaactcttgcattttctgattttggaagattatagttttctcccacttcaattccacatttgcgttttacctgagaaatatataaacttgaaaccttcaagccaaattctttcagcacataatctttgatttcctgataggttgctttcaactcggcactggtggcatccagctcgtccaggtctaagtcgatctctatcgtgtcatctggtttttgttgggacaaaagaacaaccgtctccacatgtccgctccacggaaacatatccaccggccaaacctcctctgcccgataccccaacttcctaagcaccatcaaatcccgccccaaagtcaccggattgcaggaaatatacacaattttctcaggtccaagcaatgctgcgctttgcagaaactcttccgtgctcccactccgaggcggatccatcagcaatacatccgccttagcgccttcctcagccatctgcgtcaggaactgtccagcatctgctttataaaaacgcacattcttaatcccgtttattttggcattcacaatagcatcctttaccgcatccgggttcagttccacagaaatcacattttttgccttggaagaagcaatcaggccaatcgttccgattccacagtaagcatcgattactgtttctgttcccttcagaccagccaactctatggccttcttatacagtttttccgtctgcaccggattaatctgataaaaagaagccggggaaatacggaatctgcagccgcacaaaacatcctcaatatagccttttccataaagaacctgctgcttgtcccccaatatcagactgtcagtacgcgtatttacattctgaatcactgtagtgatttccggatgagctttcagcaatgcattcgtaaaattcctttttgaaggaagcaccggtgaggctgtaaccaataccaccataacctcgccggtggcaaaggctcttcgtaccaagacataacgcagcagtccgtatctggtatcctcatcataaaccttaattttaaaagatttcagcattccgcggatcgtaccgataatccggtctgcaagttcatcctctatcagacagcgctccaccggaattacattatgggttccttcctcgtaaactccagatacgggattgccttttctgtctctgtcaaaaattgctgttaccttgtttctgtaattccatggattctccatgccgataatcggattaaaatggcctttcagttcaggacatttttccagttcctgcctgacaaaagcttcttttttcttcagctgctcttcgtaggacagatacagatacctgcagctgccgcacttcttttcatatggacactttgtttctcttctgccgcttctttgggctatatcactttttgcatctacctcattttttttactcacagacttatttctttgatcgtactgttgtctgccagaggatttgtcctgaccagatgtatatttttgagaaacattttttccatatgccgattttcctgacatatttctaccggctacagatttcccgtccattgattttcctgatatggttctaccagatacagaccttccatctgctttaccgaacatacttctccctgcagcagatttttcctcctcatctttatatttccctgccgaagtcctgcctgccgcccctcttccttctgaaggccgtccgctcctaattttatccttcctcaccttcaccctcttactaacgctatccttcccaataaaattctgtgccgccacattactgcttttattatctctacctttactatcgctacttatatcatccctgcatttactaactctgactttaccatcccatctcatattatctctgcttttattttctctgctcttattatctcttcctctactatctccaccaatctcatcccagttccccttttctctccttttcccatctcccctgctatttcccccatctttatattccctgcccgtcatctcattcccgcgtttcttttccatcgtattcttcacccttcaattgtttaaaaatctctttatattccgaaccgtaaatacttccttttctccatacaaaatagaaatcatgctccacactgaaatccttcagcctgatttcgcgcagaatgccctgctcaatctcctggcggaccgctgcctcataaaggaaagtaattccgcggccttcgcggatcaggtatttcataacctggagattgttgatttcatggattttccggaaatctcttaccgcaaggttttttccctccagtattcgttccagaacctctcttgtaccgctgccctgttctctgatgagaatgggttccgaaagcaaatcttcggtgcgaagcagcttttttccccgggatgaggcctgcagctggtaggcagcgccagctaccgggatgtatttttcggtggaatatatctggtagtcgtaatctccgcccgaaaaatagccttccaccagagcaaaatccagctttccttcgtcaatggagcgcagcaggtccgttgtgttggccacagtgacatggacggtagcttccggctcgttcaacataaaacggttgagcataaagggaagcacgaactcgccaatggtcatggttgcccccatatgcagactgcggccctccgcgccggccctggccatctgttccttcagggcgcactcgtcgtggcgcatggtcaggcccgcgctctgaagaagccgcccggcttcggtgagcaccatcttttttccctcgctgataaaaagcctggtgccatagtattcctccagatgtcttatatgctgggataccgctggctgcgtaatgcacagttcctccgcagcttttgtataattcagattccggcataccgccagaaaggtttccatccgaaaatcctgcatgagctctcctttatctcttaccggagctgacggccgtctgccgtcatttcccctgaatttctgctttctttatcataacatagccttatgaaaaaagaaattgttgaattggggcgaatcaaggggaaaaaattatgtttcttttttatttctttttttctcagacccgtattgacggattccctttgttaagactacaatgagtaatatatttttacgataataaccaacggttcgggcagctgcgtattaccgttgtttctgaatacagaagactgagggaggttttccatgattaaattgatctgttccgatgtggacggcacgcttgtgcctgatggcggacatgagctgaatccggaatattttgaccagatacggcgtctgaaaaaagccggaatcctttttgccgcggtatctggacgttcttattcgagcctgaaaaaactgtttgctcccgtaattgatgatattctttttatctgcgacaacggcgctcgtacgatttatcagggcagcctgctgtcatgctatacaatccggcatgaactggctatggagctggttcgggaaattgaagcgcttcccggctgcacgacctatatttccgcactgaaggacgggtatgtaaaagaaggcgccgatgagctttaccgttggctgacagaagggtatcagctggatattaccaaattgaggagaatgcctgaggatttgcctgccgatgacggaattctcagtgtggagctgtatcatcccacggcagctgaggaaatcgcacatcaggggttgtatcagaaatggcatggacaccgggagctgcagcttgtgtgcgctggaaagcagtggatgaattttacgccgattaatgcggataaggggattgcgctttccgaatatcagaacatgcacggaatttcaccgcaggaaaccatggccttcggcgataatatgaatgatgccagcatgctgctgcgcgcggattacagctatgccatcgggaatgcaagaaaggaaatcaaaggtctgacgcgttttgtcgcagatacgaatatgaatgatggtgtccttcaggttttacgtacgataaaataagcattagtaaaaaataaaagcccgaataccttgatttttaaggtattcaggcaataaaaaaagcagatagcgggaatcgaacccgtctctccagcttgggaagctagcgttctaccgatgaactatatctgcatgtattgaagtatatcatatgaaatccgaattgaaaagagggaattttatttcgttcataaacgttttttatatcaaattaaatgcattagaaataaatgtattgctaattatcgtattgaaaaggatctgttgtttcataataaatcctcagccaaatcttcagccatccaggccgaaatttaccggtatgccgcctgacaaaaaccaattggcttctctatcattagacaacggcggccctgctgagcacacaaccgttataactaaggagcgtcatttaggcaggaaatacaaataataaagccgtttacagccctatcgtcacatacatagtacaatagtcacacagaaaaatatttgtatacacactgcttttaaacagagtatccttataaaatagtatgaatatgaatccaagccaataaaggatattttctgtcaaaaagcggccaaatcacacacttccgtttgacaaactgatttcaaaaaaaaattatataataaggagcattcctgtaattcagaaataacgccaattgaataaaaaagaacctcaaggtatgattgagttgcatcttggcggatgtaaacaaaacaatcaaacccggaggttcataatgaatttaacacagaatgacagattaaagcaagtaacatttgacactcttattgttggagttgatgttggatcaaaaacacacttttgcagagcttttgactggagaggttttgaactctcccacagcgtgtttaagtttagcaatacggggatgggatttcttactttccttagatggactgaagaactcatgaataaaaccgaaatgaaaaaggttattgttggctgcgagcctaccggttgctactggcttacattccagaagtttttacaggaccatgacattcagcttgtgactgtgaatccgtttacagtaaacagaagcatggaactggatgataacagtccggaaaagagtgacttaaaggaccccaagacgattgctcatcttgtgaaagatgggcggtattcgacttcttatcttccgagtggagtgtatgccgaaattagagaggcttctgtctgcagagaccagatcatgaagcagcatatacgtctgtcaaatcagatacagggatggctccagaagttcttcccggagtatttagagtgttatgccgattgggattcaaccagcggactcatgcttttaaaagaggcaccgcttccagaggatatcctgaaaatcggtgcaggtggaatcaatcagatatggcgtgatgcaaaagtgcgtgcggcaggaataaagagggcacagatcctgatagaagccgcacagaacagtgtaggattggaagcaggtgaagccgcaaggctggaaatctgggttctggtaaatgactacatcctgaaagcagaacagctaaaaaggcttgatgaatacctggaagaaaaagtaagagaagtaccaaatgtggagaaactgctcgccataaaaggagtagggatgagtactgtgattggctttattgcagaggtgggtgatatcggacgttttactgacccaaagcagatacagaagcttgccggactggagatagtcaaaaaaagctccggcaaaaagaaaggacagccaagaatcagtaaaaggggcagaagaaaactgcgtaggacgatgtacgaatcggcaagagcactgatgaactggaatccggcatttcaggatgtgttcctttattaccgaaacaggacacggaatccactgggtggaatgcaggcaaagatagcagttgcgtgcaaagcgattcgagtattctacgtggtattacaaacaggctgtgacttcgatgaggagaagttccgaaaggacatcatcaggccggaagcatcctgaacacaaaagcacatactgtagcagaaaacgtccgccaaggattcaattggtgctggattacaggagtgctctctagcaatgacaaagcagagcgaagccgctaagacatagtttataggggcaagaccctgataaggagcagaagcggcaccccactatgggcaggctggacgaaggaatttaggtctcggcgagaagccggatgaacctgttagacatgagaggttagcagccatagggaagaatgggacacagattcgccttcataaaaaaaggatgacgttttatttcgtgtacctttctgaccggaaaacgaagtgcattgtagctgaaatgacacagttttcgcccgttaaaagatgctttggagttgttgtaactttataaaccattgcacaaatggctaaaacaaaggcttttttgtgcaaaataaataagaaagtatagagagaatttttatgaaaaagaaattactgtttcttgtacttgtttttatgatgggaatgttactttgctcatgttcgggagattctcccaacaaaatgttaggggtaaagcttccttcaggggaaaaactgcaattatatatgagccgtgataaagtggaagaaatcttgagtccatacgagtatataaaaagacgtaatatatatgactacggttttatggatcttcgttatacggatgacctcctgactttcatttactgcagggaggattcaggcgccactttttttaatggtttaggcattggcagtacggattatgaaaaatacggctttgagtataatgaagaaaaaaagtacaccgtaatcaactacaaaaagactgggggaaaatatgagcaaatagaagattatgacagcagcttggaatttaaagagggaattcaggtataccttgaaatttctgagggagataaatcagtgaccacaatagctgtacatgatatttattgcggtaaccggatggaatttgatgaataaaaaatcccggcagataatgatatattcccctgcgggcagacagtgaaatgaaatcctgtttactcacaggggatctttattataacggggcataccacgaaatataaagttgcaggttatacaattttatgccagtaactatcacaaatacattttgacccaataaaggtatcataagaatatctagccgagagactgtctatataactgtgtattgtagtaaattggtatgtacccggtttccttttcgacactccccagtttggttttacctatgtttgcatgacagtttttttcaaaatacgacgtttgtttatatgaatagtattgccgctttccggcaatactattctagttttccctttattttttcttcatttattatggcatcattggaaccaaatacgatattttgctgatagatcttttcgatctccctttcattgtaaaatccaaataacatttcaaggatcacctcgaactgttcctccgtcaacggctctctatcatactccataactcgatatgctacacatgcatatgctgttgctgcatcatgtgtcataatcccacgctcctttcacaccatccttttattgatagttattaccgtagctgcaggctttattcaataacgatcctgaacaaagcctgcagctgcggtactatacgttaacaaaagaatattggatgggacggctccctgcacaagcctctcgggaagatcgcgcgttctctcaggcgatggttgccctgtcgccgaattcgatgataaactgtccgtaagtctcgccccaatcccgatagggcatggaccacttttctgttatatcccgcgttgtcagatacaacgttttccttagtgcatcgtcattaggaaaaacggctttattttttgtcactttccgcagctgccggttaaatccctccagggtattcgttgtatagatgaggcggcgtatctgtggcccatagctgaaataggtggagaggttttcccatttcatctgccagttctcaacgaccgcacgatacttcttccagctgtccttcatcgcctccaggttcatgaatgcgatctcctcactttcggccccgtatacccgtttcagatccttcataaatgccttggaatccttataggctatatatttcatggtgttccgtatttgatggataatgcatagctggatccttgtttcaggaaatacggttttgatcgcatcaggaaatccctgcaagccatcgatacaggcgatcaggatatctttcactccacggtttttcagttcattacataccttcagccagaatttggcaccttcattttcaccgatccagatccccaggatgtcttttcggccttccgcgttaatccccagagcgacataggatgccttcgtgacgatccgcccttcttcacggactttatagtgcacagcatccagaaatacaaccggataaaaaccatccagggtccggctgtaccactcccttgcttcctccatgattttatccgttatattagacacggaggccggggataattcaatcccgtaaagtgcctggacatgggaaacgatgtcacgaacagtcatccccttcgcatacatagagataatctgtgcttccagtccctcctcgatcacagccctctttttaataacttccggttcgaattccccttccctgactcttgggacatcaatgtcaatgctgccgtaagaagtctttacttttttaggtgatgttccattccgctgcggggtattccccttacttttttcatctgtgatataatctgtgatctcgctttgaaggatctgttcgatcgcatcctttaccattcgctggacaagtccgtttggccctgtgatatcctccatggtactgcacttggaaagttcctcctgataattaaatcctgatgtcatatcccttaacctcactaaatttatttaccaatttattccacttacatgcagtattgtcagtagtaatgatacctattcaaaaaagaggtgtgtcgaataatctgcacgtgatacacagtttatttgacacacccctagccgaaaaaatcctttaacatcctaaaatttcttctctaaaaagtaaatgctatcttaaaatcaccatccttcccggtcgcacgcataaaggctttttcccaatcttcaagctgaaataaaccggatatgattccatccgtattcagttctcccaacataattttctctattacatagtcaaagcaccatggacttaaatgaactccgagtatatccaattctttttcgtcaccaataatggaccaatccactgttgaagggcctgaaaaaacactgaactcaacaaatcgtccctgttttatgataatattaagtccctgttccacactgacaggatttccgctggcttctatatatacatcacatccatatccgtccgtcatctccagaatcttctgaactacattctcttttgcaggattcagcaccacgtctgcaccaaactgacaggctttttccagacgtttttctagcaaatccaaaacgataagcttcttaggatttttcgtacgcatataggtaaccattccaagtccaagcgttccggccccggaaagtactaccacatcctctgaagtaatttttgctctgtctactgcatgctttgaacaggaatacggctctatcagtaatgcatccttgagcggcatatcatcaggcacacggtgcagtacagccgttttgggatacctcacatattctgccattccaccattaagtttagatttgaaaccgaaaacattgtgcggttggcagagagaatacagcccctttttgcagaatcggcattctccgcatggcacaatttggtctgcaaccaatctttctccaatctgatactcttttacatttttccctgccaataccactctgcctacaaattcatgaccaggaatgaatggaggttccacgtacgctttctgttcctcatctccccaaaatctcctgattccctgctcgcacttcaaatcccctgcacaaattccacagccctccgtcttaatgataatatcatcatctccacagataggagtttcataatccatttccagtcgataatcaccaattccataagcaaccaatgctttcattctctttggtattcctcccatctttccacctacctttctgtccattacgttcttggagaaactctcgtgaataaaaatatcctgtccaagaatataaagtttcactaataagaatactttcttctaacctttataaaattccctaccaacattccttcaacgatacgtccctcaacgtactagatatcctccatctaccggtataactgctccgttaatgtagtccgaagcatcagacgcaagccataccacaggacctttcatatcctctggctgtccccaggctcttgctggaattctatctgtaatttccttatacctcggactcttttcatccaataaatctgtgttcatttccgttgccatatatcctggggccaatgcatttacattgattcctttcacggcccactcattacagagtgccttcgtaatctgagcaacaccccctttgctcgctgcatatgcaggaactgtaacacctccaaagaatgaaagcatagaagctatattaataatttttcctcggctttgctgttccatgaatatacgtcccgcgagctgacaaagagcaaaaacacttctcagattgatgttcataacaaaatcccattccttcagaggaaactcttcactattatatcggcgctgcactcccgctccatttaccaaaatatcaagatgtcctcccagtttcctgactgcctcccgaaaaaaactctctcttgtctcatcatttcccaagtcagtgataacagcataacatgcatacccctttttacgatattcctttgccgtttcctctgctaccggattaatatccataatacatactgcagcccccgcttccataagtccttccgccataccgcggctcagtccctgcgccgcccctgttacgattgccattttccctgataaattattataattcaattttccttcccctctttccaatttactatttagaaatggcctgctgtaagaaaataacacttaacagcaggccgtaacttttcatactctacattccatatctttatgctacttgtattcacccagatattttctgtttatcacgaaaagttcttcacacatatcccttatttcctgtagactgcatactgctgaacaaagaggatccatctgtacggcattaatgactttttctttgtctttttccatacaggcttccaccacaagattttctatctgtgccgttgtatttaccagaattgctatattatccggcagttttcccacgaaaattttctttaagccgtctctggttgccagcatcggaatttccacacatgcttccttcggtaagttggtaatacatccttcatttattacatttccgttaaatacaaatggttttctatcgccgaatattgcattgaaaatatgtgctgcatattctccgctggattccagatcaatttcttcttcctgcagccacttatcaatatcttcatataaagttttctctcttttgattctgttattgacagcgaatgcatgttctccaggattccatccggttccatgggtacaatacttttctatcaagtctcttctcttccgaaaccaagcacaatattctgaactatgtcctgaagattctgtcacataataaccaaattgctggaaaatttcgtttcttacctgctcctcattcaaaatttgaggttctcgcattttatctctgagaagcggataggcatcttttccgttccacttaaactccaaatagaaagcctgatgattaacacctgcacaggtataatcaatttcctcaatcggtgcttctatccatctggccagcatatctgctgtatttaccacgctatgacaaagtccggttatattaacgctcgtatacttctgcattgcactgcacaacattcccattggattcgtataattaagaagtaccgcatcggggcagatctcttcaatatccctgcaaatatccagcataagaggaatgtttcttaaagccctgaaaatccctgcaacacttctggtatcccccacattcatactgacaccatacttatacggaatatctacttctgttttcagaacatcatttccgccgttgtatactgtacagataatcccatccgcacctctgagcgcttctctgcgattcgttgtcatcgtaattaccgccggattatgaaatgcattgatgattttctctacaaatctgcccgaatactccagtctcttctcatcaatatccatgagacacaactcggcatcccgaaaagcttcaattcccattaaatctttcaccagatttcttgtaaataccaagcttccggcaccgacaaacgtaatttttttcataatcaataccttgttcatttaattatgtactggttaacaggtcatttttccatctgcgcttctgcataacaggaatcaaacccttcctgcatatatttcccaacttcaggtacaggcgtattgtttaaaagcatagaagtagcttcacacatggaattccacacaccattgggcagatattttctgtcaaaaatattatcataatagatatcttcgccataagcttctataacctcctgatgcaattttccaatcagagagtcatccggagtactttttaaccccgcagtaccaccgtcaaaagcaaagaacctgcccgccacttcaggctgagccaaccagttaagaaaatctttacattctgcctcatattctgtgtctttccaaataccaaaggtagttccttcagatatacacatggatgctccgccgtcttctgtcattgccggaaaaggcaggagtcccagattggcatccggataataagacaatgcggacgcaatattagccgtatttctgaaataaaaagcgccggttccattaccaagcatcttatgcccgccaggctgatcctgtgttaaataatcagcattataaaaattattatcacgccactccagcatcttttcaaaacagggagcccattcttccgtaatatttattgtaccatccaaatgagaatccaactgagcatgagacgggcttgttggtgttgcaaactgcataaacagcaaaggatttagcacagaacccgcacttccagaatccatacctgatatgattactggtgcaaatcctgcatcacgaatttttacgcaggcagcgtcaaagtcatccattgtttttaactttgtccagtctacccccgattgttccaagacatccttgttaaaacaaatactggataaaacaatggagatgggcagaacatagaattttccgtctttatcctgtattacgccttttgctgcatctgaaacatcggatgcccagttctcaccactcagatccatcatatactcactataacgaatgactgaccagccgtgagtcatccacatatccggaagatcattattagccattcttactttaagctgagattcatattcctgcccgggggcaacaatatcgaactttactccagtctctgccgtatattcatccgccacttcccggaatttagcgagaacttcatccgtccatgtcacagcaagctccagtgtcacatcagattttgcagtttcttccatttcattctgtttttcactttcctctactgatgctttccctgcgccatctggctctgctgccgtttctccgctctgtccacatgcgccaagcatcaggctgaaacatgtggtaacacataaaaataatgcgatccatttctttcctttcatttttttccctcctgttttctttacttacatttccttgtttcctatataaatcccattgccaaactaatcggcaaacaactgatctatgcatagtgggccctcagctatgcacggagcatcaatcgtgggttttatattttcatcagttcaattctcagcacattactgtcccactgcgcataggtaccatgacgtgtttcatcccctgtccgaaccacatcaggaaaatatcttcctgtttcatcaaaatgtccttccgtcacactcagatattctgcatttgtagaaaaatttttccctgaaactgtcacagcacttagtgaaccatccgcctcttcttcctgaagaaagtaaatacggaacttatgtcccaccacataaaaaacattttcactttcctgaagcagcaatcctctgcatggttcccccttatttcccaatgtttcttcccagcaagcttctttatgcagaaaatccattctgtaaaactgatccatcgttccctcaaaactcacataagctctccatcctcctaaaagcccttctatgagggcagaaggttctatacccctgcggtgaatcccatggatcctgtctgttcccgtatattctggaagcactggaaccacattcctgatcatatggaacgaatgcttcatactgataccttcttccgtattcagttctttttgatcatctgtcagtagactttcccctccaaaaatatggtaaccaatggaaccataatccccgattccctcaaacatcattccgctattgaatacagagcgggatgattccggcacatagagcgggaatcctttttccggatgagaatatgttttcaaaacatccagataaccagtcacctcctgcagataaatatccggtgcgatattgtccaaatgtgtacaaaccgcataataaatatcaagattgttctggcgtggcgtccctgaaggccaatctacaccagccagccccctcccctcattcagccaggcattcgtgtaaagaaaaatatcatatatttcctttcctgccctggcaatttcatcgatataggctgccacagcccatgtcgttacccattccccccctgcagcgccaaatacttccgtccagtttccattgctcttctccccctgccttaaccattcttttgcaaggtagcagctgggattttctttacaatacgtaatcagtctttccggaacattctctttaaatgctttatcaccaaatttactgaagtccctacgcgttgcggaatgcatacctgcctcattttcaatctgcactccgattaccgtattgaattcttgatcaaatctttttaccacctctaaaagccggcaaaatgctttcctatctgcttccaaattttctggacaatgaggggaaagattatgcgttttcctgccatcctttagttctgcacggggaaacctctcggtatctttctttacccaggatggagtatattccattgttccatttttccaggttccaaaccaaagcagaatcaatttcaggttattctccctcgcctgactgataatatctgtaacaaaagcttctcgaaatgcaccctcccgcggctcaaacagttcccatgaaacggggacagccaccgtattcgcttctattttttttgcagcattccaggaatactgcaggtattccggtgtactgctgctggagttatgagtctgaattcccagggaatagaatggctttccctgcacagtaaaaaaagtttttctttccataccacattcctctctgctctatttacgataatgtaattactgattaaggctgcagttattatgtcaaaataatctgaattttttcctgttcaggaaattgtaacgtctggcagtcatttgcataggtacgttctggaagcaccgtcagtacatgtattggcttctctccttttacaaacggcgcagcatgccatacgcctggattaatcaccgtcatagttcccttcggtaccaggaaaatctcgatcttatcatacggaaccgtctccttctttcccgccggagctacatgaatcaaaatatcaccatccagcggcatgaatgcctccccggtataactgtgatattcaaacttttcggcaatcagcggtctcggtgaaatctgtgtcactgaaaatgcaggattctttccattgaaatctactttaagaatatcccgataaaactcaaccggaggcggtccgagccgttctgtatccatgattaccatgctgtgatatgttccgaatttatggaaattccccggattaagtacatttacgtttttcgttttcattgcttctcataccattcctttatcttcttttttagtacgctttccggagcctcctctatcatgtccctgattcccgggaaaagtaatgcttttttcaatattgtctcatccatagtatctacaatttcttccatggacttatgtgcgttcagggaaaggttattcaatatctttcttaaatcggcctgaaattcttttcttgtttcaggataaccgccgccatatgtgtcgttaaaaagcttttcaaatatgtattttaggttaatgtcaccgcctactcctccataacctttgtttaacggcagcgatacacaattccccgcattgattctggaatagaggaaagcatctgtaggatcggtcagaaggccacaaaacgtacctggatactggagaagagcattcatatatccctggccagtcccacaacctccaacaacgaaatcaaccgcctttagattcagtgccagtgccgataaaaatgccgtctccagatagttcagctgtggttcaccctcaagatccttcattccgagattcacaggttcatatcccagttcttccagtgcctttagtacatcgccatttctattttttgtactgaattcattgataaccgctattctcatttctttactaccttcctttcaagatattttacaggataatgaatcggttctccttttgcaaagcgtactgcctcctgtgctgcctttcttttcagttccttttgcgcttcttctgaataccatgccatatgcggtgttacaatcagatttttcagtccaaatagcggagaatccttgcttaccggctctccaatcatacagtccaacgccgcgccggctatctctccgttttcaagagcttgcttcaaatctgcttcatttacgatcccgcctctggccacatttatcaacactgcgctgtttttcatttttttgaaagccgccgctccaatcagattttgattttcctcggccggacaatgaatggatataatatccgactttacaatcagttcatccatggaaacagcagatacgtactttttagtttcagaagttggcttgtagtatggatcaaagcctataacatgaaatccgattgaatgcattttttctgcaaagttccttccaatccttccaagaccgattactcctacagtcatttcactgaacctgtgtattgggatcgcttttgtataatcccatttgtctttctttgttagctcattcatttccataatttttcttatcatggaaagagccagtgaaattgcgtgatccgctacttcattcattccatagtccggcacattcccgacctgaattccatatcgcgcggccgctagaacatccacattatccactcctacgccataccgaaccacaaacttcagtctcggacaattctgcattaccttttctgtgatatgcgcatactgaatgataaaaatatccgcatcctggcaatttgcaattacatcatcttctgttgttacatcttttaagtccacactaattccagcctcagaaaatatgcttttctcaatatcgatattatcatggtcacaatctgtaattaccactttcatccttgctcctatctgcacgccaaaggcgtatgtacaaatcaaggatgttgaaagttatttttctttcaacattcattccctgtctctttcaggcctttccatctgccatacatgtcctgatccaacgttttacttcttccttcaccgcatttaccgcaggtttcatcaattctgtcgtatagatcgtcggtccttcccggtctagaacttctttcactgtgcttagatacgtatatttgataatagtacctacattcaccttattaattccatttctgatcgcacgtctcacatcttcctctgggattcctgtccctccatgcatcacaagtggaagttctaacgcttcattcacctctgcaagtcttttgaaattaatttccggttttccctgataaaagccatgtgctgttccgattcccacagccagaatatccagacctgacttctctgctagttccacagcatcttctactcgaaccaaaaaatcatcttctgtataattcccctcttcagtacgtcccttaatcataccaatctccccttctacgaaaacaccgcggggtcgggcataatccactacctttttcaccctcttaatattctcttccaaagtctctttagaggcatcgagcattaccagggaatagttttcatcacaggctttctgtgatacctgaacttctgtagaatgatccagatgcagataaactggtacctttgcactttccgcaagtgcttttgccattgcaccaactacatgcattcccagagcgtcatttactttgggcaatgccgccgcgatcaccggcgaatgcatctcctcagccccctttacgatcgcttccaaatcccagatatctgagaaattaaaatgtggaactgcatagcctccctcatcggctttttttaattgtttcataagcgtttcttttttcatgttactcctctctgcgcatctccggcgcgcgttcaaataatatagtgagaatcagaagaacacacctcccaccttctcccaatatgcagcttaaacgctcttagttcccgtccttcacggccttagaaattcttctcacacttcacatcagaaaatctcttatttccttttcatcaggttttactggatcagcttccaactccggtatgtatttgcaagcttcccagattctcggcgccactttcccgtagacaccaacacaatggtgaatatatgggccttccataaatcgtctctcccacagcggccagttgtcaaattctgcccatagataggttccgaatgtcttaggaccatctactccgcggccgtgtccgaacaggcaggaatacttaccattgccgccatcaaagcgtactactgtgatatcgtcatgcttcagttcccattgccccacagcggctgtttttctattgaaatgaagctcaatttctgcatctggatcgtctgacaatactcttgggaatacaccgcaatgccagagaagttctgcattgtcattaacgggatgtcgaatggtgagatccgctaaaaacgttgcgctactatatctggctgccgcggcagcgataactgatgaaaccgccccatgaatatctgattcacagacgactggtatcccctctccagtcagctctgaaaaagtaaagcagacagatattcctgctacggtagccataggcttccaacactccgctgacacagctgacaaatgattatcctcacaccattttttaatagttagtttcagattagccatctttgtccaaatatcttcactatatttatttttaggaaacctttctttaagtgaatcaacctcttcccgtaccaaatggttattttctgtgagatttatctttaacatctcatccaatgtcgccaatgtaatcggatgaatctcaattccgaatttttccatcaattctctctcgttagcttttacactccaaaaagcatctggccttacaccgatttgtccgattcttaaatgattaagagcctttacaatggatacagcccccaggaagttctcaaatcctatgtcaaactttttatctgtcatccaacaattggatatataggtatatttaaccctaaactgctgcagtacctttgtaagtgcaaacattccgcattgagcatcccgcagtctgtccccattttcatccggcgcctcatctctcggcccccagaccagtaccggctttccaacttctcttgccattttcgccacagcttcctcagaaccaaaattacagaatgggaaaaatacagcatccacttttttgtttttaaataactcactggcggcattaacatcggatacctgaaacagaagcccttctttatttatactgtccagattgacccattccacatcttgaaatttttttacatattcttccacttccttttttatcctgagcgcctcatctgtactgaaagcctttggagttgtaagcacgcggcgggtaggcgcaaagcctattcgcaatgttttcctattctctttcattgttgtttcactgcctcctttaccagtttctccccttctggagtctgcattaaaatatggttaattgtttctatatactccccttcatcagtagctcccagccttgatacagcacgggcccccgccgcattggcataaagcacactgtcggtaagtttccagtcatttagaagcccatgtatcagacctgccataaaattatcccccgcccccgtcgtatcaagcactggggacttaaatgaaggaatcagcccctcaaatccctgcgttaacagataacagcctcttcctcccagcttaacgccaacatgcaatgcccctctatcaacaaaaaaatggacgatatcttccggtttctccagcccggacaggtaagaggcttcttcatagctcgggaaaaaataatccgtatattccagaagattttttattcctgcaagccctatatgaaaagcatcgtattttgtatcaagaaccgtagctgtttttccttctcgtgctttccggaatagttcgatacttgcctccctgtcaaaagacggcatcgagtaaagtccacctatacttacaatctttgcctgctttgccgcttcaaaattgatatcctttcctccaaagtttcgcagacaccctttaaatgtacaaaaccgcctctgccctcccggatataccataacgatacaggaacttgtcccaatctccttatccagagcaaccaaagaggtatctacccctcttgccttcatctgatccaacaccatatttcctgttacatcatctgcgaccttggatatcaacgctgttttatgccccagcgccgacaaaactgtcgcctggttaaaagcgtcaccgccgcacatgaccgtaatctcctccacctgcatggtatccccgccttcaaatttttcaggaaacggatgtaccacaatgtttcccaatgcaagaccaacgcaaagtacatcatatttcttttcttctccacccttcatgattttgtcacctcgtaatcatttctatttaacagcgctgtcaattgcaccctttataaaatattggttgagcagtatatatgccactaatgccggtaacattgccaccgcacagcaagctgctgccccttgaaaattggaacttgttgaagaaaaatactgttttaccatcaatacattggtatacagctcaggcttctgcagaatataactgggatacaaataatcgttccatgcctgcacaccctttatgattattaccgacactgtcaccggcttgagctgtggaagtataatatataggaaacattgaaaataattagccccttctatcctggctgcctcatccaaagctcgcggaatagacgtaatgtaattggtatataaaaaaattgaaagaggaagcccaaatgccgcagtaatcaaaatcagtgcccaaagtgtattaatccctcgaatggcactcaaaattgaatatacacccaccaataccgacaccgccggtaccatcataatggccaggattaaactgcggataaattcattgaaccgtgtctgttttctggccaatggataagctgccaaacatccacagaaaacttccaccgtaactgtccctatcgtcacgattaaggtgtttttataggcattaagcatattattttctttaagaacctttatgtaattatcaaagtaaatatagttgggccaggtcagacgggaagccaaatctgtaggctccttcaaagacatttcaatcaatacatacaatggcatcattgtcaaaaaaacaagaattaagcctaaaatgtatttccaccaatgctttctaatatattttttccatgttttccctatcattaatattccacctcccttttcctgaagtatctgtttgtgacactggaaaccagcataataaatacaaacataaacaccccaattgctgaagcatacccggccttttccaatctgaaataatttagcgttataaaagtagaaagtgaatgtgtatcatgcccgggtcctccgtttgttaaggaaacaattacatcatttagtttcagacttccgatcagattaacaattactgcagatgtaatcgccggaatcagcaaaggcatggttacataacgaaaacgctgtatggcagtagcgccgtccacttcagcagcttcataatataatgcaggaatgccttgaagccctgccagatacagaaccatggcattgccataatactgaatactgttgacaagcagaatgataatcctccctcgtgaggaatctgcaagccagtccaccggtttccgtccaaaccagcccaaaatctcattaagtattcctccatcatactgtaggaaataatacataatgtaacccatgataagaccggatatcatgattggaagataaataaatgtcctaactgccgtatgtcctttaaacttagagtctacaagcagcgctgtagccaatccgaatatattctgcaggatcgtggaaccgaacccatacaacaatgtatttagaaatactgtccgcatacttctgtcggacaacatattaacgtaattatcaattcccacaaatctcctattctgagaatatccgttccagttataaaatgagagccgcaatccattaaacaatggaaaggctataaaaaacaacatcaacactaatgcaggtaaatagaacagatttaaactgtttttccttaaaaattttttcatgacatacccctttcattaccaatttttgccaattcttcatacaacttaactttctataaaattaagttgtatgacaagttagaacaaaaaaattcccatatgcatacctctcctgttctttttccttccacctacacttttgcgctgtccagcagatgcttcttcatacaacgggccgcttctcttccattccctttttcaagttcaagcaatatcttccgatgccattccaccgcagtagagaacttatcttctgtattaaacgcatgatgctgagattcaatctgtcccataatatattccatgcttcgtacgattagatcatttcctgtcgttttcagtatttctttatgaaaagcaatatcttcattgataaaagcttccctgtcggatatactgttcatcatatttacaagatggattttcatacgattcaaagcgtcctcagtcatacgctgtgctgccagcctgcagctctctccctcaataataatacgaaactcaacaagctgctccacacttgtattattatacaacgtttttaatttctgctcgatatcactgatgggcttcgttttaacaaatgttcccttgccctgaaagctttccagcacgccaaccgcaatcaaatgctgaatcgcgtaacggacgcttgccctgcttacagaaaggcatgcagtcagctcgttttcagaactgattttatcacctggtttccaggttccgtccataatcttctgttttaaatagtccactacatcttcggttacatttttatgttctgatgaactcattcgtttgacgtcacttcctttttattttttataaaacattcaaaccacctatcatataatatttgattttaatgccacaagatatgccccaagagccgctgttgcattctcttcttccgagacaaaactacggatttccccacccacgccttcaaacttcagaatatcaaccagtgcctgtctgagaggattcttcccgcacacaataatatccatattttcatatatttttatagcatccgaattttgaatcgcctcaatatccccctgaagacttgccccaagaatataatttgcaatttttcttgtatctgtctctgcaaaaagattcagtatccttccagaaaaacaagctctgcccagtcctgtctttctggcatttcgatatccggccaaaagccattttctatcataggattcttcttccacatattctcggctaactgatttcgccaaaattgtattatttgtaatagaagcaagaatttctcctgaaatagatgtcagacatccttcaatctttcccttatcgtttatagagacaaatttattgtgtgaacccggaagaactaaaagcatgggctttccactgaaatatcgatcaatcaccgcaacactttccacttcctcaccacgcataatatccattgcctcataattgtctaggcttatatctgctattgcattctttattcccggaataaaataaatcggcagcggacatatttcttcaagcttcaccggaacaactgcacgagccagttcctcaagtcctgccggtgctgtcagatggggtatttccacaagtcccacatctgatgtaatcataccgctggcaataattctgtaaacctgatcataccccaaatgttctgcagctagcaagttttccaggcactccttaaccgcagctttcagtttttggttatttccgtcaatagctgtatttcttacgcctacacctcgccgctcctccgccatctttttattcgtattatcccacaaaatacaacgtgtattcgttgtccccccatcaattgttatcacataattcttcatcagcttatccccccgcaactcataccttactcttattataaggcattctctcttatatttcgtacatactctctggcattactggttattttttcaaaatctccacaagcaattacttttctgtctgccagattgctgcccactccaacacaacagcatcccgcattaaggaaatcagtacaattttcaggcgtcacatttcccaccgccgacatggctatatgttttaacggactgcgaactgactttatatactctatgcccaatattccagcaggaaataactttacaatatcagctcctgcttcataagccattacgacctctgatggagtgaatgctccgggcatggaaactaatcctaattgcttcgtttttcgaattacagcacagtttgtgttcggagaaataatataagcagcgccagccctggcacactgccaaacctcttcttcgctcaaaacggttccggctccaacacatagttcctctccaaattcctttttgagcaaagtaattaattcatatgcattccttacagagccggctgtactgtgatccagagcaatctcaagacagcttatgccgccttttttaatcgcccgtgccatatccaggatggcatcccgttcaattcctctgataatcgcaataattttttctttaaaaatcagatttaatgtccgctccattttgttataccaccctttcaattgactgacaagtaatacaagttttaatctcaacagtatttacaacttatatgtagtatatatcacattagacatctttttacaacaaattagtcccaaaaaaataaaatatggctatttgcacaatttttgcttaattagtcgagaaaaatccaaagttctttattcattttttctcaacttgtcatacatattatcatttaaattaataattaatgtattaccttttccattccatccactcgaattatttctctcaagaacgttggcaaaatatataggcactaaacacaacagaatacaacactccaaagcctccctgcaagttttgttgatatcaactataatataaaaatactccttttgaataagaatcttaatattttgattctaactcaaaaggagactcttctttcctgagacaaatatttttatactatctacctggctgaaacactctcgttatcccaggctttcctgaataaattcactcagcacattagtatccacaaaagctatagtattttccagatcctttatccgcttgtcccgaagcaatcttatggcaagctcattcagatactttttgtccaaaaagggggctataacatcaaaatcatgaccgcctctttcatattctttttcagcaatttcctgaaggatttcccttggaataaacggcagaatatcctccactccggcaagtccatcattttcataaatcatgcctgcaagctcacccatgctgcttctttctataaacggcgcaatatcttctatattttttctgtctgctatcatcatttttacggtatcgacgataaccttctgctccaggaacggagccgcatcctcgatatcatcatacctgccgttttcagccgccctgtatgccagcttatttatcgtatcctggttaatgaagggcagcaattcagtcatttctcccagttcaaattcctgctttgcattctccacaattctttcaatctgagccggctgtaaaataggggcagcctccttcagttcttctgcagctaccagcgtatttcctaaaaactcttctatatctccctcaattatattggtaatcagctctgatttttttcccagcagttcatcaatactaatgccaaacagctccgcaagctcaggcagcttcgaaatatccggcatggagtttcccctttcccagttggacactgcctgaaagctgatattcagtcgatccgccagctccatctgtgtcatattactgacctttctgaattctgaaattttcctgcctatttccttcgtatcaaacatattttctccctttcctctgatagtttcctttccgttgatagttttctttccactaacattttttcactgacagttttccgtccgcagcattatcgtatcaaatcccaaccgccttttccaacaagtaatggttgaatacagttaaaaacatccattcaaatatcagttgaatcagttgaaccgcaggcaaatccctcccgtccaccatccaatgtcataagctccatccacgctgcaatccataatagcttctcttcccactgcctccttgccgcatccttgtctctccctattttcccctgtcaccaaactccgccaactcccccaccccaatcaccgtcagcctgtgcatagctcgtgtacacgcaacataaagcagccctctgtcaaactcggccccatacgtatttttatccgcatccgccaccaccacttcgtcaaattccagccccttcgccatccgcaccgacgttatggataccccgtcggaaaacccggtgctttccggggatatcagcgtcactttacactgtcttgccagggcatcatacatcgcctccgcctccctgtccgttttcaggataatgcccatggaagcgctcttccccatttcccttcgttcctcaaagctttgcacctcttctctgattatgcctatctgcgcctgcctatctccacaggcaattacctgaggttcctctccgtgccgttccatggcttccagcagatcgttggggcagatgcgcctggcaaaggaaatgatttcataagtggagcggtagcttttattcagcatcacgaattcggcgcttttgtacatccgccggatatccttcagcgtgtgcagatggtctgggttcaggcgctggccgaaatcgcccaatatggttttgtgacagcgaaacatttcattgaggacggcatactgtaccggcgtataatcctgcatctcatctatgaccaggtgctttgtcactccgctttgcttcaacccttcaaatgcggcacgcaggtacaggaagggatagacatccgcccattccagcgtccggggggcaggcatggcaaacaacccggcaattcccattttttcatagaaatcacggtatagcgccagagaatcctttatggtaagcatattcatcaggcttttttctattgccgctgcacgcggcagttcttcccctctgatattttccgtctgcatacgctcccggatatccccggcagtcagcgcaaggcgcttttttaccgggaattttgtgtaggctaaaaatcgcttccggatccattccttctccacaaagaaacggccccaacggtaatcctccggcaaaaaaacagtgtaaggcagctgtctgcggtattcctcaagaagtcttacgaattccagggttgatttgtaccgcacccgttcccggaatttttcatccttcgtatccaacggatcgctttccggcacgaagccgataacgccctccagctgcagctgtgcaagctcggcaaaacccagttcgaaaataggctcctctcccagctcaggaataacgtttgctatgtaatcgccgaaaacccggttgggcgaaattatggtcacgttgcgcgagcttaattccttttggaagcggtaaagcaaaaaggcgattctgtgaagggcaatggaggttttcccggaacccgcgactccctggatgatgagggtttccgtcttttcgttccgtatgatccggttttgttccttctggattgtggctatgatggatttcattttttcatccgaggttgcgctcagttccttctgaagcacatcgtcctgcacattcagggagctttccagcgcgtactccatcacaccgtctgtgattttaaactgccgttttctcgtgagcagccccgtgatcctgcctgccggggcctcgaaagaggccggtccgttttcatagtcataaaacatgcctgataccggggcgcgccagtcatatatcagtggcttcttcttatattgaaagccaaagcggccgatataatagatttcatccgcagggctgccgtcctctctgaagtctatcctggcaaaatagggggactccttcagtctggcgattctgtccctcactcctgcggcaaaagcgcctgtcctgtcggtctgttttaaaagaagttcgttctggaacatttcatgcgggtcgatctcgccccggttgtccgccatgtagcgtttggcctccctgtattcctgttccagcctgtctgcattttctcccgcttccgcaagcgcctcctccagccgttccagtgtctgtgccaggtggatctgctcctcagggaaagggaggggcttctcctgccgcctgcacgttatttttcccccgctgtctttatgcatcgcctgtttcctccttcttcagcacaaaccgctgcgtcggatagccgaattccaccagcagctccgcctctgcgaagcccaaccccttgatttcccggcgctgtccggtgtccgccttatccccttcccggtacgtggtgatgctgatttccctgccctttgccagctcgtccatcaccttattaagaaaaaccctgggaatgcccattttccggtaaaacggatgggttcccataaaatcaatatttcctgtctcagtgtcaaaaagcaggattcccacggcgatacctccgtccttcagtatcagcgcctgtcctgcacggattttttcctgcaggatccggatatattcttcctcatccaggcagggaaagccatccaccacaaggcgaaccagctccatccagcagggaatgtcggtttcttgggcaaaagcggcctcccatggcctgttttccttattctccagcatgctgtagctcccctccaggctgtattttaactgcagcgggtaaaaacgttcattttcccggtatctgttgggcggcattttatacagggctgtaaaaatcccggtaaaggcctgctggctctcataccccgccagcagcgcgatttccagaatcggcttatctgaaaaaaccaatagcttcgccgcctccgtcagccgccttctctgtatgtagtcatgcgccgtcagtcccgtcatatcggcaaacatccggtgcagatggtacttggaatagtggacggcatccgctatggtatccaggtccagtttttcggtcaggtgcgcttctatatattcaatgactgccgtaatattttgtatattcttttgcatgttctcctccttccgaagccttattatacccaaccgtgacgggacatttttcatcaatcttgcttttttaagaaaaaagccggcctgcacgcggcagaccggcccttaccctccgacctttattctaacggccggttttgtttacaatccgtatggaaaacgccgcggaaattccaatgatacaggccgacagcgtcaatacgcagcccgcagcggcggcgggacgggaaagaagctgccatgcttcgcctatccccagctttcctgccagataataaaatacaagaaagccgacagtgggaataaacataaatatttttcctctaatcgagccgtacttataatatccgggcagctgtacccctgcgtatatggtaaacagcagcatgccaagaagcagggaagaaagcagatcgccgcccgacggcggggactttaccgcccagagcagaattgcgctctgcagcgccgtttccaaaagcagcgccaggtaaccgattccgaatacggcaagatatctgcccgctaccaggcttcccctgcccacgggcaggaagccgtaaaaccgctccatcccatttttttcagatatggagaaggtgtacgctgtcgtcatggccgtcaccgtaacgccgaaggacagcccttccagcaaggatcctgtaaaaaaaggaaacatcagcggtacaagaagcaccagcagcacggattttgcatagggcttcagcagcataaaatcaagtttcatacatttcatagcagggttcatatgttttcctcctgactgtttctgtcggtctgtctgctcataaagaccacaatatcatcaatggatgcaggaacacattccaggcggccggcagcggccaaatcctctttcctgatcagcgcctcaaagcctgtggggaaagtgcgcagtccgatgagccgggcctccagtctgggggtaagctccttcctgtctcccctcacaacgcggaagctgtccgcaaaatcctcctttgttcctgtaaaaatcagctgtcccaggtggatataggtgatgtagtctgcgattttttccagatcaggtgtaatgtgggtggaaaaaagcacgcttcggcggccgtcctcaatatactcacacaggatatccagcagctcgtcacgggataccggatccaggccgcttgtgggttcgtcaagaatcagaagcctggcgtcgtaagaaaaggcgcaggcaagcatgagcttcatctgcattccctttgacagttctttcaccttctttgtcttgccaatcctgaacctggaaagcagggaccaatatttctcagaatcccaggcgggataaaaaagcgtgtaggctttttccacatcagccatcgtccactcatccacaaagctgctggaatcaaaaacagcgccgatatccttctttatctcctgctcggaggcaatattgtcttttccgaacacggttattttcccgccttcgcgttccgtcatattcagtatcgctttaattgtcgtcgttttaccggagccgttagggccgatcaggcccatgatatagccttcgggcagatcaaagctgatattatccagcctgaaatccgcgtatgatttttccaatgcctccacatgcagcatgctatccatttattttttcctccatacattgtctgaacaggtcggttatctgtgcatcgccggctccggctttcctcgcctcccggatggcgtcggcgaacatcgccctggcctcccctatcaggtggtttctaatcagttcctcactgctctgggcgacaaagcagccctttccctggatattctctatgtagccctcactttccagctcggtataagcgcggttaatcgtgagcacccccaccttgagatctctggccagggaacgcagtgagggcaggatatctcccggcataagctcccgggacagtattgcctgaagtatctggctttttatctgctcgtaaatcgggccgtcatagttgtttgataccacaattttcacatctcggtccctccttcatcagctggctgatatgctgttatgcacatcactataacagttgtattattatctgtcaatggccttgtatctgattttctgagtaaaatattggcagtcgtccttgacagaaaatcgaactcatagtacgattatcataatatcagtatagtaaggatgaaaaatatgaaaaaagaacacttagtccgctttcatcagcagaatatcctggctgccgcggagaagcttttttccgaaaagggcatgtgccagaccaccatggacgatatttccagggctgcggaatacagcaaatcaaccatatatgtttatttccatagcaaggatgaaatatataactacattattcacagctacatgtgcagtctgagggataccctgcgtgactgcatccgggaaaacccggattttgaaagcaggtactttgcggtctgtaacagactgtgttccctttatgccggcaagcctatgtattttacaagtatactgggatatataagcgttgacgagcaggctttagtggaaagtgaaatcctccgccggatttatgacgtgggcgaggagatcaacgatatcctagctgcatgttttgagcagggaatccgggaaaaatacctgcggcaggatctctccatcctgcccgctgtttttaccctgtgggcctcgttgggcagcctgatccccatggcctatgaaaaagaaacctatattgaaaacaggatgggaatgaaaaggtcggactttctgcagtacggcttccgcctgctgctcacctcactgaaaaaggaggactgacgaatgggaatttttatgggaatcctgtgctttttatgctttctcctcctgcttgccaaggccgcatccaggaaattcggcctgaaaaaagcagaccggctttttatgaagctgcataagcctttatccgccgtgcttttcctcctctgcccggttcacatttttttcgtgctgcggacgccacgggcaatgtggttgtcccagactgcagggctgtcccaggcgacgcggctgtcccagacggcacggctgccaggctatctgtcgggaggctgcctgtttctgtgcatgcttgtcctgataaccctgtgccacacctgccgggacgagaggcgaaaactgcagcagcaccggattttatctgcaatgatgcttggatgtgcgctcattcatacctggatcggcctgttttctgcggcttgaacctccgtatgtgctgttcctttgtatgtgctgctcctctgtatgtgtcgctcccctgtatgccccatgaaaacactgattgtttccgcacgtctgtctccatgggaccggcgcatggaaacgcccccaaaggaggaattccaaatgaataaatcaaaagcggcccctgaagtccgaaaaaaaagatgcctgatcctgtactgctccagtcatcatcagaacacggagacccttgtaaaaaaagctgctgcacagctgtctgacattgctgttatgcctctgtcagagaactgcctcccggaactttcccattacgagctcatcggcctggcctccggcatttatatgggcaggccccatgcctcaatgcagtctttcctggaggctcaccaaaaggagctgaagggccgcagggtttttacacttctgaccagcggcgccaaccagaaaaaatacggcacagccttttcctcccttctggaaggctatggctgtaccgtattggggaattaccaatgtaaagggtttgataccttcggcccctggaagcttatcggcgggattgccaagggacatcctgacaccagtgacattgcaggtgcgcaagcttttctgcgcgggattctcaggacgcaggcctgatacctgccgccacgcattcacacggtctgtgcgggcctatccgccgtaaggcctttccccgcgtcatgctccagaattacccgcagcaggatttccgcagccagcctggaaccggtctctgaggcatgctcgccgtcaggcgcatacatttccgtttccggatgggcctgcttatactgccaccattcctcgcccaccggcgcaagcacggcccccagctgttccgccatttcccggtatgtctccgtcattttctgctgtccggcttcattcgttttctcagcccaggtcatataggcaaccggtgtgcttccggcttcctgaatccattgattaatcgactttgccgcttcaagcatgtcctccttcggcccgaacggatgggcatgttcctgaaggaccacataatcataatttccataaagaatgttaaacctgacctccggctccttctgatgctgatggaggaaccagccgccatgggtgagcattgtcacctcacaggcaatccctttctttcttgcaagctccgcaaaaatctccggcatatcattaaaataggtgtggctgttgccaataaataaaactctcattccctgtattctcctcttctttggctttctgcggattttcatccgacaaagccaatgcttttctactaatcctgatgtattaatcataatataccgtaggatatttttcatcataaaaataaagaaagaaccgctatgggtacagacggaaaaatattccgctgtggccggaaactccaaaacaataaaaaacgaaaagcaggaagaatcgttggtatcattttcggctccgcaagatatgaaaatataatagctgtggatattgaagtggaagaaacgtacagaaggcgcgacatcgccgcctttctcacagagcatatgctcagcagctgttctgaagaaaacctgacagtacagtgggactgcgtggaatctaattccgcctcccgcatggcagcagaaaaatgcagtttctatttattcaagaagcgcccttattattggtttgaaatatcgtaatctgtatatggaataaactgcaaaggcacaacgttcattttatgggcaacaaaaaagcctggtaaaaaccaggctttttccatcggagtgacaagacttgaacttgcggcctctacttccctaaagtagcgctctaccacctgagccacaccccgaagctttcttatgtcgtccgggctttcgctccaaccgacgaatgttagtatacaaaaaaatcccaaatctgtcaatatgtttttttaatttttgcaaaaatatgttttgtgatttttttattattttttgtcacttatgaaaatgcccctaagaagcgtcaatgctttcatatataaacataactgttctaaaaaataacgcttcccacaaaggtattttctgaccagcaatataaaatcattcagccacgtttcaccgtaagataaagtaatatatccactgtaaatatatttttatcgcaggttattttcatatcaccattatactttttaatcatatcctttacgctatccagtcccaggccatggttttccttatcctcttttgacgttagaagtttattgcctgaggtcttaatgcagccacaatatgaattggatacccgaataaaaagtatccctttatccgcggtaatttgcagggacagccatttaacctccgtctgccgtgctgcttcaatcgcattatcaataatatttccaagaataaccgccagctcaaatgaacaggtatgcaaatcctccggtattttgacctgaacatcaacttttttaagaatagataccgctttctccagcataaaattgagaataccatcgatatccttattccccgaactgacatgctccctgggatttatcattgcctgctccattttatcaagatattccaacatttccgcgttcttattaagcgaagccatactatacagctgcataatatgatggaccatatcatgccgcagccgcctgatttttttctgcgtctgcgtgattgtttccaactggctggaataaacttttacctttaactccatcatctctttttcacggagctgatgatgcacttccataagcatattatacaaataaaatacaacgatattaataagcagtattcccatgctctcacatacaagcagaaatctgttattcaggttaaagctaatcagcataaaaagcattattatgcttaataccggtattataagaaggtattttatcccccgcgtatactcctgtttcgctttattatccaggagccgtgcagcaataagttctgagatttggattaaaaggactgttacaatagaaaataactgcggcgttgtctgtccgactttataatcaaagaaaaggaagcttgcgagaatatcgctcaccatatttatcgtgtaaataagcacggttgtagttattttcttgcggatgctgccatcataaagaagggtaaccaaaaaagacatatcagattcgtggcaatattcacgattggataatgaaaaatcagaaacatgccaaaacttatcacataaaatatcacataagcgattacttcagttctttttcctgcctttctttcagtaagaaaaagaccgacaaacttccagacaatatagatacggaagagatttgttacggcggcgatcaaaatatcatgtatactcatccctggctccttctgttatcaattatctgatttctgacctggttccggtagcgtctgctgatattcagttcatccccattaaacatttttacccgttcgtatgtatattcaatcacataatcctggttaatgacatatgattggtggatttgcaggaaatttggcggcagttgggtaagaactgcttttattttaccataaaattcttttatcccctgaaaggcaacaatctaaacttttctgttatcgctggtaatataaataatattttcacaccattcacgacaaaacacatttccattccggtattctaaaaatatcttccccaggccctctattttcagaaaaatccccactgcttttttaacagcatcatattctaacggtttctcgataaaatccaggggttgtacactgaacaactgcatggcgtaccctttatgataggaaatgaaaataatttttgttttaatatcattcaggctttcacggataaattttcccacctccacaccattcaacgtcagaagctcaatatctaaaaagagaaggtcaaacgcattccccatttcaagatgcttacacagggtttctcctgaataccagggttcaatttctacatgtacattaaattcccgaaaaatatcaatcagcatactttccagttcgcagcacatatttttatcatcgtcacaaatcccgatattatatactggcataccatttctccctcaaaaaatgtatcatgactttcattatagcatattttgtggccgccatatcggttttgagcattttcaccgataccgttatccctctttttctatggcgcaaatactgaatttaccggtatgctgtctcgcactaatagtcactatatagctgccctcaagatcaaaacccacaaaatagctgcctgttagcatatcgctttccatagtacctaatacatgaatacgggtatcattatttgccgttatttccgccagccggatacggtcacatataacataaaatccaatggttgcttatttccattgaaaaagtatacactgcattatcgccgacaaagtacagtttgccttttccttttgatacttcaactgcgatgtctatttctccgccttctccgtcataaaccagtatttctgtcccgtcttccgcaatgtaaaccagggacatagaaccattttcacaaaccacagtcccttttacagacagctccgtccgattcataccggttttactctggtgaactcacctgtcttactaaaattatatgcaaaaatatcccgcatcctccatgcatgatgaaaacagcgccttttactgctgaaatcggcatacgttcctttctcagtccctccattcctttgcgggcaggcgaaagtgttcacgccgcacaaaaaaagatgcctgaaggaatctccttgagaaaaaaacagctaacctgaaatttcccccagattagctgttcctcttctattgttcaatttttactattttagatatatttctgaaatgattccagctcaggacaggcagcctcccccggaaaccggaaaagaatttgccacatgcagtaattggcctgaaaagctatgttcatcagtgaaacaaaccggcataaggatacagtcttccatccatgtcagtttttatattacagcttccattattaaaatcacatgtcagcttcagtttaaacaaatccactgccaccgattccacaataacataccaaaactctcttggtacgtatataattggacaatatcctatcaacatctcatctttactgaaaaattcaactaaatctttatcctggcaaaaatattgtaaaatttccaaaacgtataaattttttctcatttgtagttacctgtaaattatattgagaaaaattatacgccattagatatatacattcaatataccaatagataatatcctgcaataaaaacattctaaatgttactattatacgcctctttaatataaaaggcacaacaggcgcagataatcatctgcgcctgttgcatattcatatcagatacactcctgcaattccttcagtttgaactgctccgccagataactcaataactgcgcctgggaagaaagctcctcgcttgcagccgcgctctcctccgccgtggaggagttcgactggataacacaggatatttcattcatgctttccataacctggcggacagccgctgcctggccttcggatgccccggcaatcgtattaagcgcattggttatccggtcaacccctcttaccgcttcagctaatgcacctgccgttttgttcgccgtatttttcccattttctatgttccgcaaatttttttctatgaaagcggccgtatttttggaagctgccgacgcctgatttgccaatttccgtatttctccggccaccacggaaaaacctcttccctgggcgcctgcccgcgctgcttccacagctgcattcagggcaaggatattcgtctgaaaggaaatatcttcaatcgtttttattatttttataatttcttttgaactgtcgcttatttccatcattgcacacagcatgtcttccatatatctgctgctttcctgtgttccggcctttaccttctgcgcctccacattagcctgttttgcattccgggcattttcttccacccggaccgatatcccgctaatcgtactggaaagctcttctacggaaacagcctgttccgacgcgccccgggccaggctctgggcgccggaggccacctgctccgaaccggacgccacttcggcggaagcctgcctgatttgaagcaaagtcccgctcatcctgacgttaatctcatgcatggacagcagaagctgcttcagttcccctacataactgctttcaaaattactgtgcacattaaaattaccggccgccatttccttcagcaagctggattcgtcacgtattacatttgaaagcagatataccatcccccgcatatcatcagccagtactcccaattcatcctttgactgataatcaatcttcacatcggataacttcccctccgccagattacgggcggctttttccagctgggctaccggccgcgtaataccgcgtgttatgtatataccaaaaacgatgctgacagccacgctgatgcttccaagtaaaaacagtgtgacaacagccttcctctgcctgcttcttaagccatccaccaggctgttccccctggtctttccgctttctatcagaagctccagctctgcctgggctttcttaatcaccagtatattgttatgctccatataatctgctgcttcttcccgcctgttcagggttgccagctccagaacatttttccgcatcggttcaagctctgtgagagccgcttccaaacgggcaataatatccttatccccaaggaaatgttcctttatcactggcagctgttcctggataatcgcagccgaatccctcgcgttggcaatagcttccgccgttatttccggatcagaattagcaattgcacgataaacagccttctgcatcctctcaaaattggaattcacaatatttgcgctgtcatttacgataaaaggcccctcataaaaggtttctatctgtctgcccagccccgccaggtgagctatgctgacagcacagcccgcaacaagcaatacaagcaatactgcatatgaaataaacagtttccatgatactttcagatttttcaattgtatttttgcctccaatggttttgtcaaatgggaatcaatccccaacagccggcctgtccctgtatccccgccccctatacttcctgttcctgatttccgccgtcgggaacccgggaaaatgatactgtatacttttctatctgtacataaatttccagaagctccataacctttctttttccctcctggttgaacctggaaaaggtgtccataatctgtttctccaaaagatgttcacccatactcctgctacccgtaagcggcgtaaaatcaatgggatcaagctccagcagcatgcatatttttaacattgtaccatagctcatggtatatgccccgttattcagcattgataccagtgaactgtagggtatttcaattctctgtgaaaatttcctcagatttccatactgccgttctatttcatttgccagattccgcgttcttgggtcatcaaattttctcatcgtgtacctcccacaccattttcccagctgttccgttatatttcatgcctcagacttaagcttttccgtatacagccaaaaaagcatctcctcctttgccccccccatacaacaggtttcatctttattcacatactaattgcattctagcatgcaacggctgactgcgcaatcttttccggtatattgcctgattacaaagcaaataccttaaggtaaaagccgcccggacactctgttcctttataaaaccctgccgcgttcattttcttctgcatgagcaaagctgacagttcaggcagcaaacacaaaattaccacatttttttcgcactctcatcacaattccataataattccatcacaatttctttttatactacatcttagaaacaggagataaagattctttcataaaaaaggtgaaaaggagttgaccattatgtttgaatatcagaataataactatgaaaacagaaaccagatgtatgattattaccagatgccggaaaccggcgggccggcctccaacagaccttcaggccctaaaaaaaccggaaaagcagggaagcttgtaaaaaaaatcggcgccataactttaagcgccgcgctctttggcagtgttgccgcaggctccttccaggctgtcaacacactcatcggccctacggagacttcagataatactgctgccgcagaaaacacctccgccagccttttaaaggcagccgccatccccggcgcagcgtctgaaaagggcagccttgatgtatcggatattgcggaaaccgtcatgccctccatagtttccatcaccaataaatccgttcaggagatacaaaattacttcagcatgttcggttacggaggacagaccattcctcaggaaacagaaagccggggttccggcattatcatcggtaaaaatgataccgagcttttaatcgtaaccaacaaccatgtcattgaaaacgcggatacgctttccgcaggcttcatcgacaaccaggtttacgaagcaaatgttaagggtacggatcccgcaaacgatctggccgtaattgcggttcctcttgaaagcatttcagcggataccatgtcgcaaattgccgttgcatccatcggtgattccgattccctgaaagtgggcgaacaagtggtagccatcggcaacgcactgggctacggccaatcagtcaccacaggtatcgtaagcgctacgaaccgtaccatgggctccaatacccaggtggtaaatacctctgctgacgtttccgccctgcctacctatatccagacagatgccgccatcaatcccggcaacagcggaggcgcgcttgttaacatgaagggtgaagtcatcggcataaactccgccaaaatggccagcaccgaggtagaaggcatgggttatgccatccccatgtcaagagtttccgatattattgaaaacctcatgaacgaaaccacccgcactaaggtaagcgcggatcagaaatccagcatcggcatttccggccttaccgtaaatgaatctgttaacagcatttatggcattccttccggcgtctatgtagccagcgtaacgccaggaagcggcgcagataaagccgggatcaaaaaaggctatgtgattaccggctttgacggcaaaactatcacacagattcaggagctgaccgaacttctgcagtattatcccgctggagaaaccgtggaaatcacagttaaaatccctgccaccggcggaacttatacggaaaaaaccttatccgttacgctcggggcggcggaaagcagcaataatacccaaacggaatccgggcagcaagaagacaaaaataattcaatttactaatatcagcttctgaccctccggcgcattgccatttcagcagaaatgtacgtgcgccggagtttttttcacttcatcatttgttatctatgttcagatttccttcttccatattcatccatgcagtcctcttccggatttttcatgcaaagatgtatggcttcgcccgtccccaattcccaaaatatccagtatctccccgtggggccgccgcgcatcctcctgaaatacatgaatccgccccgaatccccgcacctgtcaatataagcagggaataaaaaaccgcactccggctttcccggttcatattcccccaccagcgggcaaatcgcgcatatcagatattcaaatacctcttccgattcccaaagccgctccttgtcggaagcctttgccgggatatcatagcagtcatggaaaacaaggattgcatactccgaagccgcatgataatgttccataaccatatcataaaaagtatccatcagagcgtcattcttcaacccgcacgccttcattgccataagcatctgccacatactccccggtttctgcacgctatccgggaattcataatccttcagatttacattggttgccgaaaagggaatggttttggccagttccagctttttcgctctttccggtgaagataatttcaaaaaattcgtattaaaacttccctcaaattccccgtccctgtccacataacaccctgcaatcctcgttatggaagtccgcgaaagcgtcatccgcctcgtaagctccagcatgtcttctctgttaatcatacgctcctctttcctcacatgcatcagaatgggcacccctcatttctgattgatgccctgcaaaaatacatttcttttttcaaatcacagactgttgtggtttttcacatctgtctactgcatcagctctttcttttcaagaatcgcctccacggccgcacaggccggacagtcacaatatttagccccggccgccttaatttccctggcatgggccgcaatattttttgcattgtcagccccgaaaacactggctcctgcttcggactgcgcaaaactgattaatccgtcaaccgtcacgatatccgcttccagctcagcaatatacttcgccgtctccgccgcctccctgtcagtcccgaccgcatccagccaaacctgggccgccgccttcgcctcgctgctgcaggatgcagcgtccattaattcatgtgtttttttcactacaaaatccaatacttctctgtccataacctaataccttctttccccaaattttgtttttattttaccataattaccgggtcggcgcaattcggagctgcactaaattccagtttggaaaataacagccgattttctggactccatgataaataatttttccgatttgccataaaaacttcctcccccatcattgacagtccccctctccttgtgatatggttatctacataagtagttaaccacatcacaaggagccatattgatgaatacattccttaactccgacaaatccatctatctccaaatcagcgaaatcatagagacggacatcctgcgcggaattctgctggaagatgaaaaagtccccagcaccaatgagctgacaaagcagtataccatcaacccggcaaccgctgccaagggaatcagccttttagttgcggaaggaatcctttacaaaaaaaggggcatcgggatgttcgtttcccccggcgccagggagcagattcttgaaaagcgcagaaaattattcaaagagcagtatatcccgaagctgcttcaggaagccgccagcatcggcctttccaaagaagaagtgatacgcacaattgaaaccggcggagactttgcgtaattttcctcctctccccctacgcagctgcctttcgcggcttacctttctccttccggagaggcggccccaatttgaatatcctgccgccggacgcggccctaaccataaaaaaggagtctaattcttcatgaaactgcaagcagaaaacatcaccaaactatgtaacggaaaaaaagtactggatcagcttcaactcaccctggaaaagggcaaaatctacggcctcacaggaagaatcggcgtaggcaaaaccaccctgttctccattttatccaaacagctcctcccggacgccggaaccgtccatctatatgatgacaacggccgggaattggagctgactctcgggcgcgtcttttttccggaggatctttctctgaccatacaggaaaaaggacgcggcgcccagagcctttccggctatttccaggagctgtcacacatctgccccggctgggacagcagtctggcggaaacgctggccggccgctatcagctttccccggacaaaaaactgggcgagctgtcaaaaggcatgatgtccatgacatccattattgccgccctggcgagcaaagctgattttacatttctggatgaaccggaagccggcatggataccctcagcagggaaaaattttaccaaatgcttttggatgaattttccggcagcggccgcgcttttgtgatcgccacccatctcattgatgaagtctccgatcttacggaagaagtgattttcctggatttttacctgaaatccacgctggactgcggcagaatacgcctcatggaaaatacccaacagctgctgggacgcagtttcctcatcagcggcctgaaagaaaaaacagaagcccttgcctcaaaatacgaatcctatgacatggggaatttcggaagaagcaaaagcatcgccgtgctcctgcggcccggagaaagcctgccggaggacccggaatttaccataaagccattaacgctgcaaaaaatattcgccgcattatgcatggaagaataacggagggaactatcatggccgatattatggcggaagtaaatcatgttaaaaaaatataccgtctgaatataaaggagcccggaattaaaggcgccttccggaacctggcacatgccagatggacggaaaaaacagcgctggacgatatctcctttcaaatgaaggagggacaggccctggcctgcatcggggaaaacggcgccggaaaatccaccctgattaaaatcatgatcggcattctcacccccactgccggcgatgtaacagtttacggcgggcatccccgggaaagcggtaaggaatatcttcggaaaatcggcgttgtcttcggccagaaatccaatctttggacagacctgcccgtcgaggaaagctatcaggccgtaaaaaccctgtaccggctggatcccggagaatacaagaagaactatgacatgattgtgcagctgctggagcttgccccgattttatcctctcccgcaagaaagctctccctgggccagcgtatgaaggccgatatcggcatggctttcctgcattctcccaggcttttatacctggacgagccgactatcggcctggatattaatatcaagcataccatccgcagttttctgaggcagatgaatcaggaaaagggcgtcagcatattcctcaccagtcacgatttggatgatattgatgaaatctgtgacgacgcaatagtcctttccggcggaaagcttttttacaacggttctctggatgccttgaagcagcagtatgtccatgagcgttccatcagggttaccggcgtccagaagtccgatatccgtaaatatcttccggatgccaggatttccagggaaggccgcgtcacccgcatcgattaccccatgcaggcctacggggcggaaaccgtcctgaatgccgtatcccaggcctttgacattgaagatatttccatccaggccccggatatcgatacggtggtttcccacatattttcccgggaaaaggaggcgtccgccttatgagaaactttctgaagctgaccgcaatgtccctgcagagccagatgtactaccggaccagtttcttccttaatcttctgtctcccatggtcctgcttgcagggcagtatcttctgtggcatgccctgtaccagcagcagccggatcacatcatcagcggtatggacgccgcccagatgtactcctacctgctcattgcctttaccctgaaccatatcatgggctggtcctctgagaacgcgctatccaaggaaataaaaaatggaaccgttgtgaaaagatgcatccgtccggtttcctttctctctcagtccgttgcggaaatgaccggtaccctgctgccccagcttgcgctcaatctgatcatagcatccgcgggattccttttattcggccgttttctgctcgtgccctctttgcagaatatcgttttattcctgccctgcatggcgggcgccctcctgctgcgcatcctcctcatcgagctgtgcagcctgctgtgcttttataccacaggatatctgggcatcagctggacccgcaacgccatatttgaatttttttccggcgccctgatccctatcgtcatgttcccgggctggctgaaaagcatggcctatatgactcccttcccctacatgatacagatcccgatcagcatcttgctgggccaggagctgaacgttcccttgttccaggtatacgccgtccaattcttctggatcggcatttttctggcgctgcatggattgttctacaaaaacatccgcaaaaacctgataattgcaggaggctgaaatgatacagatatttttgaaaatgaaggaacagtacataaaaacagaaatggaatatccgctgaacttctggctcatgctgctttccggcgttgtgacaaggttcttcgggatgctggttccatttattatctgcagcaatatcaaaacgattgccggctggaagcaggaagagatctatctgatcatgtcctttctttacctgtctgaagggctgtgcagcgttctgtttgaagggatctggcagttgccttccatggttttcaacggaaatttcgacaccatcctgtcccgccctgtttcgcctttttaccaggtgctgtgcggcggcatggggcttcatgggatcggcgtggtcctgttcggattcatcagcctgaattacagcctgatccggctggggattttccgtcctgcgtccatgctgatgtgccttttctttgtcctctgcggcaccataatctgtatgtccagctacctgcttacaaacagcctggtcttctggtacgatgcgggcggcaggaccagcattccttatatgataaccgaaatcggctcctatgcccggtatccgatcatgatctatcccaaaatcctgcaatttatcctgctctttgttgtgccctacgcttttatcggcatggtcccggtaatgatccttaccgggcagcatatgctgtccctgtgcgcggcactggtcctgataagtcttttcagccttctcggcgccagatttgttttctacagagggattttgcactatgaaagcatgggtatgtaagcgccgtataacgataaaaaaatccgaacccccgtaagagagttcggatttaaactttttgagtggacccgaagggattcgaaccctcggtctctgcgttgcgaacgcagcgctttcccagctaagctacgagcccaaattaattttccgaaaaaaatggaggcaacgaggctcgaactcgtgacctttcgcgtgtgaggcgaacgctctcccggctgagctatgtctccatgggtattattttaccacatttttcgaaattggcaagagaatgtttgacaaaaatcctgtaaattttcaggcattattacctgaaggcccattttccgcagtttccctggcatttttaggctgtccttttttccctttaggagccagttcggcgctgtatgcgtcaagaagcttttcaatcagcagctttttcacatatacatcaaaactgagcatgcagacaaaagagaacagctgcaggaacttccgctcttcttcctccgtctccttgaaggtctggccggctttggtgaatttctccaccagatccttcttcaatacctcgacctcttccctttccagactgaacacctcattgtaaatatcctccagcgtaagatcggactgtcccttaaaataccgttccgtaatcggctggagaatggtctggatatcatttatggacatcacacctttataatagtaaataaaaatcaggatcagaacatgctccttggaatatttcttcttcacagggggcggaagcagattgttctttgcatagttattgatcatcgtcttcgtaaggatcttgtcgccgtccggattcctggtgctgtttttcagcttgctgtccatcagcgtggttacctgatccatatataaatcaatattgggaatatcctccggctttacataatcaattctgtcaaggcttttcaaaatgctgttcagtaaatcttctgtcgaaatcgtcattctctgctcctgtcttccgccctttcatgcacggacaccgcggcccggaattcccaaactgtaaatatggaaccggatatatgataatatatatctgttctttattatatagtatcgaaaactacatgacaagcataatcttcctggcgcagacatttttctttactttaaaactttagtatgttaaaatcgcagtatatgagggacagaagtaaactatattttgtcttccctggatagacacaggaatcgtacggaggtaaagaaatgaacaagaaaataaaaacagacgcagtggaccatctgttcgaagctgttctgagactggagaataaggaggaatgctacagcttttttgaagatctgtgcaccgtaaatgaactcctttccctttcccagcgttttgaggttgccgccatgctgcgtgatcacaaaacctatctggatatcgcagagaaaaccggcgcatccacagccaccatcagccgcgtgaaccgttccctgaactatggaaacgatggctacgaactggtattttcaaggctgaataaggaagcgtaagccgggaaaattgctggtaaatattttcagaaaataagtggtataacgtaaaaaagcactttacattcgaatattcttgtgatattctgactatgttgcaaggcaacatactaattcttatttttttgcggaggtatcctagaatgaacaaaggtacagtaaagtggtttaacaaccaaaagggttacggtttcatctctgatgaagcaggacatgatgttttcgtacactactccggactgaacatggacggctttaagtctctggacgagggagcagctgtggaatacgatgttgtcgaaggtgaaaaaggaccccaggctgttaacgtaaccaaattataagatcaggcatcctgttgacctgtcttatcacgaaccatcacaatgtgccttttttgatcaaatatatatttgtagaataagctgtacagttgtaatggattccaccaatggctccgcttccccatgtaccgaaacgaccattgaatttaaaaaggagcgttctgaaaccggcatctgccgaatcggaacgctccttttatatctctgtacgaaacatcatattttttcacttccggccagcccgccacatttacgtgccagaaacagttaacagccgccggagtatctcacagctcctcttccgcatatgcctgtaccctgtcaaaatccaggctgccgccgtaaaggttcagtgcgcttcccaccgtaatgtgtatcttattccggcccagctccttaatgctgcggatatcctccagggagcggattccgccggcataggtaatgggtatcctgttccatcttcccagaagcgccaccagatccttttcaatgccgcataccttgccctccacatccaccgcatgaatcaggaattcatcacagaaggaggcaaacatgtcaagcacatcctcattcaggatcaccttcgtatatttctgccaccggtcggtaacgatataataggaaccgtcctttttccgacagcttaaatccaggaccagtttcttctttcccacgttctccagcaggcggttcagattctcataggaaatcgtcccgtcacggaatacataagaagtgacaatgacatgggaagcgcccgcgtccagatactcatgggcgttctccgcagttatgccgccaccggcctgcagccctcccgggaatgcccggagcgctgaaaggacctgttccctggagctttcataataggggcttcccttcttgttgagaagaattacatgcccgtttttcaggtttttttcctcaaaaagcctggcataccaggccgcatccttctcagacacgaaattttcctgcgcgctgtcactgatatccgccacactcccgccaaccagctgcttcacttttccgttgtgcacatctatacatggtctgaattccatttttttatctccctgcctctgaattagtaaacttttttgtaactgttcagcaggtcagcgtatttacttcgctgaccgtaagaaaatgattcaggagtgctaaaatccatcgccaaaggcgatttaggatggattttagcagtaactgtgaggggtactgaacagttacacttttttttacaaaattaggtatattttacacgaatttatcccatttgacaattcccttttccgaataaaaagaatttttccgaacataataaaaaacggacagatattttgttcgaaagtgcgcttctgttttacagacacacccaatcacaaagaaaaaaggagtgagcaaaatgaaaaagctgaacagaataatacctgcagctctgattctgctgatgcttgccagtgttacagcctgcggcagtaagaaaaacaacgcggatgacatggcaggaaatacaacagagtctgcttctgctacggaagaaacagcaggtatgaacaacaccacaggaaacggcgctgctggaaacggcactgctggcaacgaaacggcaaatgaaacaaatacgacaggtatgaatgaaacaggcaccatggaaggcactaccgaaaccgcgggcctgaatgatactaccggtataaacggcaccaacaacggcaccaccggcggcaacagcactgcaaacgaaggttccaatatcgttgacggcgccggaaatgccattgatgacgcaggcgatgccgtgggcaatgttgtcgatgatgccggaaatgcagtaaaggatgcagctgacggagtggcaaacggcgtcaaggatattaccaacaataaataatcctgccgcttcctcctgtctttgaccgcaaacctttaaccacaaacagggcaggccccgcctgccctgtacatatcaggccgtctgtaacatgaaatatctgtaactgtgaaaataccgcacagttttatttttatcacacgcctttttctataagcgtaccgtccctgtaggccgcaagcagctcctccagataacagatgctttccttgagctccgcgccgatgtccgtatccgcaacccggatccgcctgggcgccgtttccacaataatggagtcggaaaaaatatccgattccttccgaatggccgcctccgccgattcaaaaggttcatgggccaccagcgtcatgccgtgggaatttgccaccagcgtatagcctgcgattcctgttttcccctgataggccttggaaaagccgccgtcgataatcagaagctttccgccgcatttaatgggcgtttccccctttttcagctctacagggacatggccgttgatgatgtggcatttttcgtccaggccgaattcccgcagaatccggttaagcacctcctcgttgtccatcaggcggtaatagctgttctttatctccacatgggtgctcttatcctcaacgaaatagcgttcgaaggtggccattttatcttttccgaagaccggggaattggggccggtccagatataccagataatatccttccctttttcccgttcctccttatcctgggagtaatagccctttctggcatagtgatccagaatatcatacagctcctttccgctgtattccttcccgtagacgttcaccttcaggaaatttccctcttcatccatgggcacgcagccgtggtaaagaaggttggaattgtataccttgtacaggcttcccttggaaaaaaggaaacgtacatgccgctgcagcttctcgcagtgcacaaacgcatggcgcagcctctccaccacctgctcttcttcctccgtcagccggtaagggtcggccgggtcaatggtggggaaatccatgtccttcatggcatattccgtaccgttaatggttaccgtatttttttcataatttattttgtccagaaggagtctgtcggccatgtcgaattccggccgtttctgaatcagctggccctccagcttgaactggatgatggcaatggctttgtgcatcttcatatccagctccatatccttcatgtcgtaatcttcaccgtatttgatggaaaaaacgctgcagtctgagtccgcataggtattcatggcaaaggtggcaagagggatcaggttgattccatagccctcctccaggatatccaggttgccataccgggcggaaacccggataatattggcgatgcagctggtctggccgctggccgcgcccatccataccacgtcatggttaccccactggatatccaccgaatggtactggcttaaggtatccataataatgtgaggccccttgcccctgtcaaaaatatcccccacaatatgcagatggtctatcacaagccgctgtacgagattacacagggcaataatgaattccggcgccctgccgatgcggataatcgtatggatgatttcgttataatacgcttccttatcctgcacctcttccttttccgtgatcagttcctcaataacataggaaaaatccttgggaagggctttcctaaccttggaacgggtatatttggaggctacgcgcttggtcatctgcaccagcctgtgaagggtgattttaaaccagtcctccaggttttcctggctgtcctcctcctgcatgatcagctccagcttctcctttggataataaatcagtgtcgccaggctgcgcttatccctgctgcttaaggtgttcccgaattcttcgtcgattttacgctttacgcttccggagccgttcttgagcacatggttgaactgctcatattccccgtggatatccgtcagaaaatgctccgttcccttcggcaggctcaatatggcctgcaggttaattatttccgtggcagcatccgcaatggtgggaaactgcttggacagacttttcaggtaagttaattccaaatcctgcatacttgctgtttacccctttccgatctcaggcgcttctggacttaacaaaaaagggaatcctcagattccctttatttccgcgggcaacgagccaagcagccatgcctgcatggctatttggcgactgccgcgggagtcaaagtccgcattacacgccttcgattacatcactcatatcatacagtcccgcaggcttgcccttcaggaatttggccgcctgtacggcgcccttggcaaatacattcttggagtatgccgtatgggaaaaggtgatgacctcatcctcccctgcgaaaatcacgtcatgatctcctactattgtaccaccgcgcaccgcagaaagtccaatttcttttttgtctcttttctgccttctggtgcttctgtcataaacataggtgtattcattattaaattcttcattgatggaatccgccagcgccagcgcggtgccgctgggggcatccaccttctggttgtggtgcttttccacaatttcgatgtcaaagccagccggggccagcacgccagccgcttccttcaaaagcttcagcagcaggttgattcccagagacatattggcagatttcaaaaccgccgtcttacgggaaagggccttcacccgctccagctgctccggggaaagtcccgtagtgcacagcacactgggcatcagctgtgcttcacagtaatccagcagcttatccacagcggctgccgaagaaaaatcaatggccacatccgccagcagggaaccgtcctgcccgcaggcctgcctgtaatcctccaggcttttataaaccggataagcgttggaaatgtggtcggatacgtccactcccgctattatttccatatcggcttccgcttccaccagacgggtaatcacctgtcccatgtggccgttgcagccgtgcatcagtatttttaccatatcattaccatccgcgccggggcgcgcgcctttcttccaaacgaaatacggattacaggatgccgaaatccttcatggccttctccagcttcaccgcattttcctcttccatttccgtcagcggccttcttaagggacctgcctccagtcccatcaggttcatggccttcttaacagggatcgggttcacctcgcagaataatgccttgcagagcggaattgccttcagctggatttcccggctgcccgccacgtctcctgcaaaaaatctggcgcacatatcatgggtctgtctgggcgccacgttggaaagaacggaaatcacgccttttccgccaagggaaagcagcggcactacctgatcgtcattgccggagtaaagatccacatcctcccccgtcatgctcatcagctgggccacctggctgatattgccggttgcgtcctttacgccgacaatattgggaacctccctgcacagccttaccaccgtttccggaaggatattgacgccgccggttcttcccgggatattataaagaatcatgggaacatggatggcctccgccacgattttaaaatgctcataaagccccttctgggtagccttgttataatagggagttaccaccagaacaccgtcaactccggctttttccgcttcctgggaaagatagaccgctgtctgtgtacagttggatcctgttcctgcaataaccgggattcttccggccgtctgctccacacagaaacggattacctccagatgctcctcatgggtcagcgtggaagcctcgcctgtagtcccgcatacaatgatggcatccgtgccgcccgcaatctgggcctcgatatgctcagcgaacttctcgtaattgacacttccgtcctcatgaaaaggggtgataatcgctacgcctgctcctgtaaaaattgccatatgctcctccttgtttacgcactgtactgcgtttcttatgtggcggcgccttccggcccgcctgatgaaagttaccatgaatataatgctgccggatacggcagaaacggtaactgacacacagctgcagatttgtgcagccggcagcaacaaaaattctccggccatcctgcttatgtaaaaatccagaggcggccggagataaatttcctttttatgatagcgccccatctgttatagatgacagtcatatggttgttcaccctatgcccaagattccggccgcaggagcctttctctttcggcgttctcccctttccctcttcctcaactgtgcctgtcacatcggaaaagctactcttgaatcacgcaacctctatctggaaataatcatagcacgcgcacaggttcctgtcaacgcgcagatgtgatgattatgtgtgttcctttctccaaaaaaaacggagaagcatgccccgcacgcttctccggccgccgcagggaaagtccccgcggaaccaatctttgatttttttatccggccccgctgccgccgcttccttgttataacgcaggcatccctgcaacgcggtcttccgcagaggcatacagccgctgccgatccgtcacttgattgtgcgtatctcggaaacatagtctgccagggcggatacatccttatccagggaaatcccggtcatgataatatccgtctcaccatccctggattcaaggacatttttcaaatcctccacggtaatgattttattatcaatcaggcccagcacctcatccaggatcagcatatcgcattctccggtattgagcacctttttggcataattcaggccgtttctgatattcctggcctcttcctcctgcttttccttgggaagagttacaaaatcttcatcggatttttcgaaacggaacagcttgatctccggctccagcctgcgctgataatcattctccgtcaggcccttgcccttcaggaactggataatcactacctgcgcgcccttggccgccgctatcaacccacagcctatggctgccggcgacttgccgtgtcctgttcccccataaatatatacttttccttctgccatatgtacgcccctctacggtatttacgcggccgcagccgccgtcttcttccgttcgcccgccctccggcaacgacagccaaacaggcctgcccggcggactgtctcatttttccattttttatcataccatatgcatcaggccgatgcaacttttattgcagccgtacagtttattcataattttccattattcttcaaccagctccagcttgctgacggacacctcataggcaatccttttttccagctggtcctcgccgatttttttcatatattcacggctctggattctgccccagatttcgcagcgctctcccacgttgaagccgccggcgaaacgggcgttgcgtccccagcagatacaggggatataatcggattttccgtacggccggtttacggccaggagcacgtcggcaatttcccgtcccagaggagtctttctgtaaaccggttccttgcagatatagccgtccagataaatctgattggttttggagctttcctccagttcctccacaaattcaatctctcttgcgaatacggacaaaatcagtcggttctttctctcttcgtggcggttataggaacggaactgcccggacacacacacataggcccctttataatcctcttccacatcgagaagcctttcggaaaccatcagggggatgatgtcataagaatcgctgagtcttgcaacctcaacgtccaccatatagaagccctctccgaaaatctcgtggctgaattcaaagtcgctcacgattttccccataatgattacctggttgttttcaattaccttatctgtcattttttgttctcccttcttgggccccggtttgaccggaaccgcatgtaagaattttttcctgtcatgtattactattttatggcacgaaagcccatcctagaaccgccatgggtcgccccgatttccgtaaaatcgacagatatcgggggtttttgcaggtttggtgttgcaagttgattttatcggtgctatactattttagtttgaagcattttgcataataataaggtagttcctcatgtcggaattcttccccggattctgacggaacggcattgtgccggtctttgggcgcagctcttcggcttccataacgccgacgcgtcagaatccggggaaaaattcaggtatgcgtactgccttttatgcagataatgaactgtaatcatgttatgtccaaggaaggaattttgtatgaatcagaaaagagaagacgtgaggaatgttgcgatcatcgcccacgttgatcatggtaaaacgacacttgtagacgagctgctcaagcagagcggcgtattcagggaaaatcaggacgtggccgacagggtcatggattccaatgatattgagcgcgaaagaggtatcacgattctttccaaaaataccgctgttatgtataagggaaccaagattaatatcatagatactcccgggcatgccgatttcggcggcgaggtggagcgtgtgctgaagatggtaaacggtgttatcctggtggttgatgccttcgaggggccgatgccccagacaaagttcgttctccgcaaggcgctggagctgcagctgcctgttattgtatgcgtaaataagatcgaccgtccggaagccaggccgatagctgttgtagatgaggtccttgagcttttcatggatctggatgccaatgacgaacagctggactgtccttttgtattcgcttccgccaagacaggaagcgccacgctgaacctgaccgtaaaaaacaaagacatgaagccgctgtttgacaccattgtggattatattcccgcgccggagggcgatcccgaagcaggaacgcagctgcttatcagcaccattgattataacgaatatgtgggccgcatcggcgtgggcaaggtggacaacggcaccatttccgaaggccaggaggtggttattgtcaaccatcacgaacctgaaaagcagaagcgtgtgaaggtgagcaagctctatgaattcgacggactgagcaagatccctgtaaaaactgcttccatcggatccattgtggcgatttccggtatcacggatatccatatcggggataccctgtgctctcccgagaacccgcagccgatccctttccagaaaatttccgaacctaccattgccatgcattttattgtaaatgactctcccttcgccggccaggaagggaaattcgttaccagccgccacataagggacaggctgttccgcgaattgaacacggacgtttccctgcatgtggaggaaaccgacactacggaaagcttcaaggtttccggccgcggcgagttgcatctttccgtcctgatcgagaatatgcgccgcgaaggctatgaatttgcagtgagcaaggcggaagtactctacaagacagacgaacacggcaagaagctggagcctatggaaatcgcttacatcgacgttcccgaagctttctccggaagcgttatcgaaaagctgagccagagaaagggcgagcttatcaacatgggcgcggccaacggcggctatacccgtctggaattcaacatcccctccagagggctgatcggctaccgcggtgagttcatgacggataccaagggcaacggcatcatgaataccgctttcgcaggctacggcccctataagggagaaatccagtacagaaaacagggctccctgatcgcctttgaaacaggcgaatccatcacctacggccttttcaatgcccaggaacgcggaacgcttttcatcggccccggcgaaaaggtatacgcaggcatggtcatcggccagaacggcagaggcgaggacatcgaggtcaatgtgtgcaagaaaaaacagctcaccaacacccgttcctccagcgcggacgaagcgctgcgactcaccccgcccaaaatcctcagcctggaacaggccctggacttcatcgagacggacgagctgcttgaggtaacccccaagaacctgcgcatccgcaagaaaatcctggatcccaccaaaagaaaaagagcaaacatgaacagaaattcataactgtaagaatcctgagcacccataaatatccaagaagccattttaacgcaactgcccggcagatatccctacctgccgggcagttttctattacatttaatttatccacacacatcaggaatatgcctccattcccgtcacccaaaatatccatccttccctcaccatacaaagcccttaaactatcgcataccacaacctctgccccttcgtgttccgtgccggcattgtcctgcgcccccggcgggtttgcgccgccatccttcccgggggcgcaggacaatgccggcacggaacacgaaggcccccaaaatttcccggctttgcttgccccatggagaaattttgcttataatgaataggtacggtgtaactgttcagcaggtcagtgcatttactgcgctgaccgtaagaaagtgattcaggagtgctaaaatccatcgccaaaggcgatttaggatggattttagcagtaactgtgaggggtactgaacagttacggtaataaaatgtcccgcgtcaggagagaagaatggctgattccaatatcacaaaaaatgcgcttgcatcatccctgaaattgctgatgacgcagaagcccttcagcaaaatcaatgtaaatgacatatgtgaaggctgcggcatgaaccgcaaaagcttttactatcattttaaggataaatacgatctggtgaactggatcttttatacagaatttgtttccagcatccatttggagcagtatgacaacggctggctgctgctggaggatatctgccgctatttttacagtgaaaaggagttttaccgctgcgcctttgccattaagggccagaactccttccaggattattttttcgaagtgataaagcccctgattccgctgtttctttcagacagtatcgtaaacggcgaggatcagaagttcttccttgattttctctgcgacggttttgtatccgccctcgtccgttggctttccgtagaaaatgaaaccaccgctgaggaatttgtgggacatttgaaaaaaattctgctcatcttcgcccgggaagtttttcaggagctgggggacgatgcctccgccatagataccgaaaattaacaataaaagggctggctgtcatctctgactgccggccctttcattgttattgcggatgcggtccatccttctttttttattccaccggtaatgccgccatgccagcgcggcgccggggatgcagggaaacaggaaggtagcgaagcggtacacaagagaggcggaaaccgcgctcacgccgcttacataggtgccaaaaaacagagaaaacacatactctacagcgccgattccggaaggacacggtatcacagccgccagcgtctgtatcagggcggtaagcagcatggtatccggaaggcttaaggaggttgtcccggcaaacaggagccagggaaccatataccagcagctgagcttcaccgcatccagcaggcagacaattaaaagagcttttttatcatgcagcaaaacgcctccctcctgctggcaaagctccgcctgctttcgaaaggtatgcgccttctgctccgctttgcttcccggcttcagttttttatccagcagccggaaaatacgggcggtgattttctttcctgcggccgccgtaatgagaaccgcggttatcagggccgtcaggatgcatcccagaaccatctgcagccggtagcttcgtaccacggtgtccccctgaatgcataggataataaagccggtgattccatagaacgccactgcgaccttgtgcagaatatactgcacaaggctcatcccggtggctgtgcccgcttcaatccctctggtattcagatagtagatttccgccacgccggaaccgctccccaatgtggccacccggtaaaaagcgcagtaaagggcgcaggaaatcccttccctgcaggtaaattccggccggtaccgttttgtcatataatagataaccgcgccctccgccagaaagtagcctgcggaaagcaggcatgccgcgccgataaccatcagcggcgtctttcctacctcccgcagtatttcaggcagtgactgcctgttcgccagacaaaccagtatgacaagtgccagcacaagcagccatttccagtattttttcagggtttccaaagcctgtcatcctttcgcctgatggtgcatccctgtatgggcgctctccgtccgttgcttttccgcttttctttccgcctttttctcttctttttcctgcttcttttccatttccgctgaccaaagctcctccgccaccggctgccattcctttgcataggcctcgcattttccgcacagatgggcagcgctttccgggcattgcaaatctgtggatttcgcgccggtccttgctatcatttcctgcagcttttccggattttccagcatcgggcagggacgaagcaggttatcgttaaagggctgtccctctctgtaagccataaacaacggctgctttaaggcatccagcagggatacctccctgatattcgcgcctgaataatggatgaaaacgcaaggctccacatcgccgttgggattgatatggcagtaattcctgccgccggcaatacagccgcccacaaactgcccgtcattctggaagtcaaaggcaaacagctgctttccgccctccatggcacggatctcacggaccctgtggaacatatatgtacgctgttccatcgtaggcatcagctccggcgccgcatcgttgccgacgggcatataatggaaataccaggcataacggcagcccttttcaataatcatatccaggaattcgtcgcttgtcaccgcctccacattatttctggtatagcagatggaggtgccgaaaatcaggccgtgcgctttcagacggtccatggcttccataaccctgtcaaagcagccgtcccctcttctgccgtcgttggcgttttcaaagccctccaggctgatggaaagggacagattccccactctcctcatctcctcgcagaaggcgtcatccaccagcgtaccgttggtaaatgcatgaaattcacagtcattatgcttctcgcacagttttatgatatcatccttgcgcaccaaaggctcgccgccggtgtacatatacagatagacgcccagctccttgccctgggtaatgatgctgtccagctcatcatagcttaaattcagcctgttcccgtattccgccgcccagcagccggtacagtgcaggttacaggcgctggtgggatccacaagaagcagccaggggatgttgcagttatgtatttttctcatctggttaattctcttggttccatagaaaaaggcttcaaagccaaggttcaatgccgtcattttaacaacatggggatcaatctcgttcaggatgcggtccgcatactgcatccactttccctccggatccctgaccagctcccgcgccctgtcatagtcctctttttcgaatttatctccgcccatgaaattctcggccaaatcaatcagctgtaaaaagctcttttccctgtcctttttaacatgttttaaagcgccgtcaatggcgatactgaatgccttccgttctgctgcatgtgctaattccataataaaatcctccattctgcggcttagtccaacgtatctttcgcaggctgccgactaattaattttattttatccgcaggtcttttgcctgtcattggacacttaattccctgtgtccttatttgggacaaataaaaaaattgtccaatttttggacaacctgccaaaaacgtcccttttcatgacaaagacgtacaagtatgatacaattagtcgggagaagctattctgccgaaaaaacgattaggaagtgataccactgaaaccggaaaaaattacgcgatttatgatagaggccgccgtagaccggggaatccgggaaatgcaggaggagcccaagcgcagcgtacgcaagcttgccgatctgggaaggcagttctccagaggacggttccagaagaatttttttgacctgtcccagaccctgcttcaggatgacaacagcccctactataccatcctctcccgtctcacccgggagaccaaccatgaaactttaaaaaaatttggggtaaatatcggttataccagctggacctacggtgccagcctgatccgttcctatgaaaaggagcacggctatgacgttccatggacggttttcatgcattatctcccggacggcccgctcggtctgaaacagatcgggggactgatagaggaggggcgttctatcggcatctatacctattttatttatctggaggaaatgccggaggactggacggaactgacggaactgttccatagctttgacaacagcgccttcctgctgtttctgcccgacagggaactggaggacggggatgcagatttgctttcaggatgccgcaatctgctggtttccgcggaaatcgcctcctgttaccgtgaaaatatccgcctgttaaagcagcgcggctgtatcgtagccaaccattactattattacagcagcgatccggaggaaattacccggcaggtgaaggactgtgattcgccgcttctcctatttatcgccagagacgactgcatgccggaggatcgcagaagggtggcggatgcggtttatgacatacgctatcatcccgaattccctgtttttcccgtggagctgcactcggatttcagacgggtggatcagatcatctccggccggacctgcttgcttgaggtggaggcaaacggaaaggtttccctgccggacggaagttttctttccgcactggatccggatatgacgcttgcaggccttctcaggaaaatctccggacagaccgtctgcggagaatatgcctgaacagcggctgaaaacagccccgccccagggtatcctggggcggggcttattttatatgcgtaactgtgttgaccagttacctttatcctttaattaattccggtaatggcaaatccgctgtcccgtccttcatccttctggaaaataatgttagggcggccttcctcagctcccagcacatattttccgccggaaagctcctttacttcgaaaagattggtggaaagcacggccttcacccgttcgtccgacaatacctccgatacaggaagcttcagaagatctcctccgttttcaatcgtctgatcctcatctcccagattcacataaagaggatatccggccagagaggaaagggaattgatatccctgtatttacaggcaaacaggatatccgctgcaaaagccagcgcttcccgatccgccgcaggcttcacggcacagtccgttatactggaagcaacgccgtcctcgcaggtgaccgtcaccgcctgcccaagaaggatgccgtcactggttgccaccacatcttcggtttcaggaaggcttaccgcatacatcatcccttccgccgtatcaataaccaggctgttcatggccgcatccacaacaattccgtcataggttccggatactgccatggggatttcctccgatgccatgtcaaaggtcccgctttcctctgtgcttcctgtctcttgtgtacttcctgtttcctcagtgccttcctgcgcggatcctgtctgcgtcgcttgggtgcccgccgtttccgccacttcctccgcaggctgcgtcacagtctccgtctttttcccgcaggccgtaaaaacaaggccggatatcatgagcgccgcaagcagaaatgcacctgccgcctttctctttgccaaactgatttttttcatatatactcccatccgcacgtcatgcgtgcttttaaaacagaggacggcagctgtcccttattccgttcccttacagttaccgggaccgctcattcctctttcaggaacagccccaccgggcaatggtcggaacccattacgtccttatagatcaccgcatcctccagcctttcctttaactgagaggataccaggaaatagtcaatgcgccatccggcgttcttctctctcgcatggaaacggtaggaccaccaggaataggcaccctcagcctccgggtaaaaataccggaaggtatcaataaagccgttttccagcagcacggaaaacttctccctctcctcgtccgaaaagcccgcgtttttcctgttggtcttcgggttcttcagatcgatttccttatgggccacattcaaatccccgcagaatatcaccggtttggtttcttccagcttcttcagatatttcaggaattcttcttcccaggtcatacggtagggcagccttgccagctcttcctgggaattgggcgtatacacggtaaccatataaaaatcagggaattccagggtaatcacccttccctcctgatcatgctcctctatcccgattccataggaaacggaaagcggctctttttttgtgaaaacagctgtcccggaatagcccttctttaccgcataattccagtactgatgatagcccggcagctccagggagatctgtccctcctgcagcttgctctcctggatacagaaaatatccgcgtccgcttcctcaaaaaattccataaagcccttgcccatacaggctctcaggccatttacattccatgatatcagcttcatattattctcctcggcttcctgattccgtttccggcaggcgcactaaaaatgcagcagcctggtcgcaatctggaaataaatgatcaatgacagcgcatccacaattgttgtaataaaagggcttgccataacggccgggtcaaagcccacctttttggcaaacatgggaagcgtacagcccacaatctttgctacaaacacagctacgatgagggtcaggcagataacaagggcgaccatgactcccaccctgtcaaaaagcatcagctttacaaaattggccgccgacaaagtcgcgccgcacagcagggacaccctggcttccttccagataaccccgggcagatccgcaaactgtatttcatccagggaaataccacggatgatggatacgcttgcctggcttcctgcatttccgcccgtatccatcagcatggggataaaggtggaaagcaccatacaggcgctgagcgctgtttcatagctggcgatgatccgcccggtaaaggtggcggacaccatcagcagaagcagccagggaatcctttttttccaggtttccagcacgcctgtcttcatatatggtttgtcactgggcacgatagccgccatcttctcgatatcctctgtcgcttcttcctggaggatatccacgatatcgtctaccgtaataatgcccaccagcctgttttcattatctactacaggcatggccgtaaaatcgtatttctggaactgtctggcaacctcctcctggtccatcagggtattgatggagattacgttttcatgcatgatatccgcaatgatttcatccggctggctcagcagcaggtagcgcagggccaccgttcccaccagctttcttctgctgtccagcacatagcagatatttatagtctcactgtccacgccgattttccggatcctggctatggcttcgtccacagtcagattttccttgagatccacatattccaccgtcattatgcttccggcggaatcctcaggatatcggagaaggtgattgatatccctccgtgtctccgggctggcgtttgccaggattttctttactacattggccggcatctcttccataagatcggccgcatcatccgccatcaggttatccacgattcccgcggcatccctttctgacagggaggtgatgataaactgctgattgtccacatccatataggaaaagacatcagccgccagatccttgggcagaatacggaaaaccttcagcatatcctgctcttccagctcctccagcaggactgcgatatcagcgtcgttcagctctgccagcatctggcggagccttgtatactgcttgctgtcaagcagctcccttacttccttgctttcttccatgacaatctccttccggcggtgtcatgacagctttcaggcatggcttcatccccggcggggtgcatccggcagcatccccggaaagcatcacatccgccttacacgttattttgttttgcttccaacttcgcccggggacaggaacatcaccgctgcttgcctttttgctcttcattaaaaccaccaccttccggaaaattatttttgtgtccgcgcgtaaaaacgccggtctgtcaggcaattagtgcctcttttacttatttaatacttttacactataacttcccgcttaatctttgtcaacaaaatagtacctgtcaaccacttccagctccgcccgcgcgccggttgcctccgtcagttcctttataagccgttcctcctccggggcaggcaccaccgtttccagcaccacccgatccgtatattccgcattttcctggggatagcccttctgtcccagaaggtactgtatccggccgatatccgaataatccgttccaatgcgtatccggcttccatagcgcatcgtcgccgtccggctcgcctccagcccggccttcaccgccgcgccatatgccctcaccagcccgccggtgcccagcagggttcctccgaaataccgggttaccaccaccgctgcatcgcagatgccttcccccagcagtacctccagcatgggacggcctgccgttcctgaaggttctccgtcatccgagcatctggtcagctgcccgcgccggccgatgacaaacgccgaacagttatgggaagcgtcccagtatttctttttcatctcttctataaagctgacggcttcttcttccgattcggttctgcgcactgtggctatgaagcgcgacttcttttctgttatttcagcggtgcctcctgtgagaacacagcggtaaggctgaaaattcgttgtattttccatgttattaactccatttgggatagataaaaatgtataatgtgtaccgcttacagtgtccgggaggaaagggatggggcatacagaaccggccaaaggcaatgcatccttaaagaaagggcagcttcagttgcctaacctccttacattacaagcggttttccacgcatattttatcttaccatattaaaggggaaaagtgtataaatttcaggcgcacaggattgtgttgaaagattataattgaaaatttatgatttggaatgccagcaatcagtgctttggcgctttcttcctcccgggtctgacaaattaacataaaatgatatgatatggcatcaaaaaagcggccatccttatatagacaggatgaccgctttttggttgattttataccctttttatattatacccattttgatgggtattttcaagaaaaaaaacgggaaatataattacgtcagaggtagtggcgtatgattagttatgaaccattttttgatactatgaaaaagaaaaatatttcttcctattggttaattatgcacggactttccaagggaacttacgagtcattgaggaaggggaagccctgcagtactgttaccattgacaggttgtgtacgttgatggactgtgatgtgccggatataataacttttaagaaagattgatgcgcggtagaacatgaaaagttttgccgcgttttttattttttttaaaataagttgacatacatactgctggtatgtataatcaaacataccgatggtatgtttattgtacatagtgtgaaggagggttctcatggcgaggaataagtatccggaggaaacgcgtaatctgattgtggatacggcggccaggctgtttgtggagaaggggtatgaacgtacttccatccaggacattattaataatctgggcggactgagcaagggagctatttatcatcattttaaatctaaggatgagataatgaatgcagtggccgataagctttatgcgggggctacggaaaaaatgaatgaaattgtccggcgtaaggatctgacggggcttgagaagctccggatggtatttcaggcgtctatttattcctcggcgcaggaggagctgtttgccgcggccccggatatgctggataatccgcagcttctgtcgctgtttatccggaattccgtgcagcaggaggctccggccatgatacagcctattttagaggagggtatcgcggacggttcaatttgtacggattatccgaaggagctgtctgaggtgcttatgctgatgggcaatctctggctgaatccgcttgtttatcattgtgacacgctgcaactgataaacagaatgagatttttccagcatatgctccgtctcctgggactggatattattgatgatgaaatgttcattcctttggaaaagtacgcacagctttatcaggagcatcagggtcgcagataatacggcggcagccgttctttgagaatttgtcttatgttcagaaaaataactgctcttcatgggcagcttatttttggcaattattcataccaacggtcggtattaaagtttaaaggaggattctatgataaaattttcagatgtaacaaaagcttatcaaacggatgagccggtgttagcgcattgttcactcagcgtaccggaagggagcgtctatgcgctggtgggaaagaacggggcgggaaaatccaccttgctgaagctggcggcaggttttctttgtcctgattatggagaaatatgttttcaggatatgcctgtctgggaaaacagggaattccatatgaatgactatcagggggcaggaaaggaactgtttgaaaaagaagtgcttgctgaaatgaaaggagacgttttatgaaactgatgcagctggaattgaaaaaaataaactggaggccttatctgggcgcggcctgcggtctgctggccttcgggctgttcatcgccctgcttttctgttttcttcccgagtcggaacggggcgtggatgacgcgcagttttccggcagctggaattccctgattctgctggtttcctgcgtcagcatgttttcctttaccatttttggggcggttcttggctccaaagtcattctggacggttatcttgggaaaaaagtattgctgcttttttcctatcctgttgaccgcctgtacttctcttatcgccgtatggttcggtttccggaaaaaaagcgcgacaactgtcatcatttcagcgcttatcctcaccgcaccaatgactaattttgcatccgcgggcatgtacggctggatgagcctggcaggctttgccgcggtcatgggagcgctgtattttattgtttaccggagcctttcccgtaaggtttctcttatggaggttctgtaaacctgacgcaaagcggctgatgtacagtttgtttttgaaaccgggctgctgctgtaaatgccggccgctgccgccagagttttggcagcatgaatacattttccggcgcatctgattttatgcgccgacagtttcgtctggaggtttatatgaaaaaaggattttccaaggatttttatctcgttgtaatcggtcagatcatttccctgttcggaaatgcggtcatccgctttgcccttccgctgcacctgctttctgttaccggatcggcggcgcttctgggtgtggtatccggcgtagcgttccttccgcttgttgtcatgtctcccatcggcggcctgattgcggatcggatgaataaaaggaacatcatggttgtgctggatttctttacggcaggcctggttcttcttttcctggtgttaagcgggaggggcagcctggtttcgctcatcctgattatgctttttctcctgtatgggatttccggcgcttatcagccttccgtgcaggccagcattcctttgctggtatcggaggaagccgtcatgcctgccaatgccattatcaatatggtgtcctcactttccggcctgctggggcctgccctgggcggcattgcttacggtctctggggcatcacccccatactttatgtctgcatgggctgttttttcctgtctgcggtcatggaaatttttatccatattccgttcgttaaaagggtgcgcacggatacgctgcttcatgaaactatcgcagatatgaagagcagccttatttttatcggacgtgaaaaaaaagaaatcggaaagctgacattttgctgcgcggcggtaaaccttttcctatcggctcttatgattgtcagcctgcctgttattgttacacaggtactcgttttcccccggaacaatgcttcggaaatgtatggttttctggaagccctcatggcgggagggggactgctgggcggacttggcgcagggcttttaagcaaacggctgaatgtcagaagcacctggaagctgctgttttgctgcggaatgctgctgcttcccatgggcgcggctctttataaggggcttccggtatatctggcttatctgattctggcggtgtcggggattcttatcatggcgatggcatccctttatacgattcaggtaatgtcttatatccagatcacgacgccacccgggctgatcggcaaggtaatctcatggattatcgctctttccacctgtgcgcagccactggggcagatcatgtatggcttcctgctggagcatttgcgcgggatgctgtggatcgtgtttgttgtgaccgcagcggctaccatgcttttcgcccgttggaacagacgggtggcgcaacggctgtagtccgcgcctcaggcctggcatgaaaaaaggtgatgctttcctctgtgtgagggcatcaccttttggcttcttatataattcaagactccaaagcagtcagccttgcttttgattcctgtacctggccccagttttcaagggcaagctcatatgtttcatttactttatcggatacacgttttaactcctgacgcagcttctgctggccttccttcagggctccgatttcgctttccactctgtcgaggcggctatccataccatcaagccgaccctccaacctgtcgagccgattatgtacgggctgcaatttttcatcaaataatcctgacaatacgtttatcagtactttctcgtccatttttactccttatctgcgctctaatccgcataacaaacctacagctgaaagtgtttttctttcagcttttgaaagtgtttttctttcagcttttgaaagtgtatttctttcagcttttgaaagtgtttttctttcagcttctttgtgtattacaggcctccggagccattatcctgctgtctctgattacagataaatactatcacaggaaggagataatctctatatgtattttcgtatttttctgtatacattctgcgtgcagacgatgccatatctgccgttttatccgagaatatacttcttcactttcctctccggcgcctggggattcagtttataaatctgtttttcaatctttcggaaggcttcttcaccggaaatccccgcggccgcgtcaaatacctcttccccgaacaaatcctccgtcaggcagaaaaccgttgaagaccatccgtattcctcacccttccgggatttctttcttgtcctgccgcagagtgaaatgtaaaatttcatctgcagctcagtcagcgcattatcaaatccgcttttgtcctctctggaaaaaccgccgtactgcttcagaagatgtaccggaagctccttttcctcactgagcacatcataaatccgtttcgccatcagggtaacattgccttcctcatattcctcgtaaaggtccgcctttcctctcctggctgccaggaaatagggataccattctttcgttatataaccgcttttcttaaaaaagagctttccataggcaatatcacgatactcatccaggacccgtatcctccattcccatggatccgtatcatcgtcctccgtatgccagtgtattttatcactaaagtaatcgcttaatgtaaaaaccccttctccgttttcaccgccgattgtaaagcccgctatcctcagatcgtctacaaaatcctgaaagccgtttatttccttcattgcctgtcctccctgttccaacctctgatttctgattctcaatttctgtcttcaagcttatcaagcagcctccttatacgccaggtacagtcggcaatcctgttttctttctttttccaattgtcggaaagtggaaaatatatcccgtcttttacctcgcttcccatatcccaatttccttcttccctttgatttgcatacagccattttgatgcaaaatgcagcatgtcgatgctgttcctgtattccgcaagcagttccagcgccgccagatatcttcccgcccctctggatgcaaacgtttccggtacattacagatccgggaatctcccgacggtctgctaaaaacataataaattcctttgtcataatgaagcacataatccatcatcaggcgctccgttctttcattcagcatgccgggaaggagggaaagctgataaaaagtcacaaaatccaccagccgtccgcctctcggcggttctccgaaaatctccgtatatgccaaagcacagtcctcatggctgaagctcccggaagagaacgcccgggttataatatcggcccatttcccggcaacacggttcgcgctcctatctgccaatgtgaatttcctgatccagacagcgagcatcagctccgtaaaaatatcccagttatgcattttttcccgcctgtccggcatttgtttcctgcctttcaggcaatcgctcatatatgtaacggttctggcaatcgcctcatcattgatatcaaagcctaaaacatacagtctgcgcagcgcctgttccgttgtgattggcgctttggacggcttacttaatgtatggaaatttccccacagaccattttcatcctgctgcgccagaatttctttcgcccatttagtgtccttatacaaatttttctccccgatttcatatctgttcagaatattttatatctttatccgggattttccgaatccattcaacgttcccggcctcttttgaattttctcactgcggcgtcaatcagggatttatcgcctctttcttccataaatttatctgatatccgattcagtaattcctcccccattcccgtccagtaaaaccatattgcaaccaaaatactgattgctagcaatatcccataatttaatcttttcatgcaccgccctcccttgttacgcccaaatatgtacagtaaaataattgttttcttcattctaccatgcctgctccgcctttatcaacaactactaaaactactaaaaagaccaccttccttcgcgcccctctggttactgttcaccccttctgaagaacggcacaagaatcccgattgtttgcggttcaccttcacgataacatgggtatcaacgatgaacacctcgctcccggagaaggaatggtaaactgggcaaacgtcagggatattatcgatgcctcctcctatgaaggctcctataccctggaaagcgacagcgccgtcattcctgccggacgcacacccctggaacacctgctgcttcattataaaggggcaaaagcaatgctttttccgtaatcgcttccggtacgtatagaaaatccggcgtctttctgctttcgttgccagcctgcatttccctgcgcctgcaggctgacaatgaaagccataacaacggttctcccatgtaaaatttatgtaaagaaaccgccctgtctcttgctctccctcacccgctcccctataatagggacaacattaatcctcagtgttttatcaaagaaaggaatttccccatggacgacgcccacagtgacgctgccccaaacatatatacacatacctgttttttaaacggcagcctgttaaaaacaggaacacacaggcatagtccgcgttcctccgggaatacgggccatgcttttttgtgtcctgcgagatgaaaaggagaaaaagcatggatctgcaactggaaaacataagaaaagcctatggcgacaagcaggtgctcagggactgcacctttgcctttgaaaaaggcaaaatatacggcctcctgggcagaaacggagctggcaaaaccactctttttaactgcctgacagatgaggtgcccgcggacggaggacgcgcgctgctttttgacggcgacggcgcgccgcggccgcttacgccggatcaggtggggtatgtatattccacgcccattctgccggattttcttaccggctatgaattcatacgtttttttatggatcttcatgaaggaaatgtccctgtgggaaagacaattgatgactattttgatatggtaaaaatcgatgcccacgacaggcacaagctgatcaaggggtattcccacggaatgaaaaacaaggtgcagatgctcatgctcctcatagcccgcccgcctgtgattttactggacgagccgcttacctccttcgacgtggtggtggccctggaaatcaaacagcttctccgtgaaatccggccggatcatattcttattttttccacccatatcctgcagcttgccacagatttgtgtgacgaaatcgtagtgctcagtgacgggcggctcagccggctcgaccattccctgctggatagccctgactttgaagccaggctgatagaattattaaaggatgaaaatgcccatgattaatacactgaaacaaatcatttttatgaggaccgccctttgggttaacgcctttctctattatctgaaacgccttcccctggcgggtaaactggtccctgattcggtgtacgccaattattccgcgaaaaaaatactggctgccggcgccttcctggttcgccagcttgttgacattacaggcaagccgctgtatcttctgttttttgtcctgctgccagcgcagctgctgtccggaaaagtacccgtatggaaaggacagaccttttccctgatggcgcatatccttttctttttaaactgtattatcggttctctgggagacagccagatcttcaccgtaaccagggataaaatcaccttgctgaaatatatgaagggcgatgtacgcagctatacgcatgcggccctctgtctgaaatatgtcccttttttcctctattacctgccttttcttatcctcttttccttactttgtggagggacggcggtacaggggctgtttctgtggattctgctggcggctgcccgcggtatgggagaagcgttccagttgtttgtttttgacaggaccggcaaggtgtactaccggaatatggcatgcagctgggccattatcggtatcggactggccggggcttacctgcttcctttgtcagggatttccctgccggcgtcatttttgctgcatccggtcagtatggtattctggctggcctgcggcggcttcagtctgtattacattattactggctataaaggttatgagcaaaaactgattcattccattgatattaattttctgctgacaaccataatgaaatcctcttccgcttcttccttcaaagaggtggaggtccgggaaaaggacgcggagctttccctgtccgtaaaacagcatacatcggcgctgcggggctatgcctattttaacagcctgttttttgccagacacagacgacagctcctgcgcccggtgtactaccgcctgatcgcagtggctgccatctttgcgctctccgttgtcttcctgcttctgaaccggcccgcggcagtgaagcttgggcaaaacatgacctccctgctgccctccttcgtctatatcatgtattttctcacggtagcggacaaagcctgccgggccatgttctataactgcgacaaggatatgctccattattccttttaccgcaggccggataccatactgaagaatttccgggtgcggctgatgtatgtatccctttatgacgcggtcatagccggcgccctgtgcccttgcgccgttattttccgcctgctgtgcggcgtcagcatttttacggcggatatgctgctgttctgtctggccatcctgctgctttccgtcctttttaccgcccatcacctgtgcctgtactacattttccagccttattcggagagcctgcagataaaaaacccgtttttttccgtcatcaatatcattatgtatgctctctgtttcctctgcctggaaatcaaagtgaccggaagcctgtttacgctgggcgtactcggctttacggtgatatatattgcggcggcgcttgttcttgtatattttcgttcgccgaaggccttccgggtaaagtaatttattgtacagacattaccggagccggttcagcccttcccccgaaactgcaccggctccgcctcatatctgcatcaaagtctcatcatttggataccttcaggaaaaattcgttaatcccctcatagaagccgattgtgactatcgttttttcgtttcccatgcctgcaaacacatactttttaaagtagggggtggtttccagcaggggattttgatcctcataaacctccggcgcctcaaggcccatgtactcgctccaccgggcaatgatttcatcggggtccatttcctcccagcgcatggaggatctggcgtaaaattcataaattctgccatcatccgcgtcaatataggcatcaatgaggcggttttcttttctggcatttttctggctggttgacaggctcaccttccagaccgccacgttgttctgcggctccggcacgtcaatggcggaatacagcaccgcgtcgtaggcagaggcttccacctttctgacggaatccggaagtatccccaaatccttcaatatctgcagtccttcattacaggattctatgatttccgcatccgtaatttcctttccggaaggccctctgtgattgactacaaaggcatagcttccttccggctcctgatattccaggccgtcctcgtccttccgggtcatggcgttctgatcgctttccgggaaggactggctgttcaggcatttcgccagaatataaagccgctcgttgctgcttaaggtatagcggtagccttcgcctgccgtttccactgtctgggcatgggtcacgcccagaatctccctgtcacggtattccgcaatggcctccggcccccagatggaaaaagccatgaccaggcacacaaacagaagaaaggcaatgttcctcatgttttttttcattccattcctcctttatccgggaggacaaagctgatacaggagcctttccccggttcactttctatttccagcttgctcccatgaaggagaaggatttccgcacacaaggccaggcccaggccggccccgttcttgcttctggagcgtgacttatccaccatgtaaaaggctttggtgatatttttctgttcttccctggggatccccacgcccatgtcctttacctcaaaacggtagcctctctccgtgagcttccccctcacctcaatagggcttcccggctccgaagccttgcaggcgttatccagcagattcaccagcaccgacttgatcaggttggcctcggccctcaccatacccgactcatattgaaaatgaaattccatctccgtatgggatgcaaacatatccttcagataatcgaaaagggaagcggcaggcaccagctggaactgcacttcctccttcttggtgacaatgatatccagaagccgcagggacatggcctccagccgctttccttccgtatatatataattggcggacaggaagcttttttcctcatccagcttacgggaacgcagcatgtccgcatagcctatgatagccgtcagcggagtcttcagctcatgggcaaaggcagccacgaaatcctccctggcctggatttcctcctccagcttattgatattttcctccagcacatttgccatatggttaaaatccgtagtcagctgtcccagctcgtcattgctgatctgccttgcccgataaccataatctcccgccgccatccgcttcgtcgccctggtaagcaggcggatgggcttggtcagccaggaggaaatcaccagcatcagcaccgtaccgaataccagcatcagtatcgtcacccggcggtacacggaaaagcccagctgcctttcccggaaaacctcagacacatccttcagcgtttccagatacaggatcctgtccagcgcattcaccgttatcccggtctggatataatagctgtcctcctgcctgatcaccctgtaggttttggtattttcatccgtctggcccagcaggccgttgtccgcttcaaagccgctgctgatatagagcacgtttttttcctcgtcggacaggcgcagcagacggctgctgtcatggccgccggtctccatgttggaggcgatctgctctatggtatgctcctgaagcacatcgtattttgcgggcacgttaagcgcggccgtctcaaaggcgaaccggaggatgctgttttcatccagcgcctgccccacctcccggtccagcgcggtctcaaacacataattgacaaaataaaatccgctgaatccgaaggcaatcgccatgacgatcatcgtacacagcagcagcttgattgaaaatttcattgcggcacctctaagcggtatcccaccttgtataccgctaccagactatgctcccatcccagcttccttctcaggcgctgtacatgcaggtccagcgtccggctgtccccgtagtactcgccctcccagaccttttcatacagggtctcccggaacagcgctacatttttatttttcataaaaagcaccagcaggccgaattccttgttcgtcagctccacgggcactcccgccctggtcacccggcgcgcttccacatccaccaccacatcgcccgcgctgagcagcctctccgttttgttatagcggcgcagcaccgcttccaccctggccacaagctccaccacgtcgaagggcttcaccagataatcgtccgcccccagcttcagccccttcacccggtcgcgcacctcatgctttgcggtgatgaaaatgaccggaatgcccatgggccggatgtattccatgatgtcgtagccatcagcacccggcagcatgatatcaagcaaaatcaggtcaaagttctcctcctctatcagcttaagcgcctccaggccgtcctggacagtccggcactggtagcctgaggcggaaagattcagatctatcaaatcgcagatgggcttttcgtcatccactatcagtatttttatcatcggtacaatgatgctcctttcccaaacaattgtttcccggcaggctccggccccttccggcccctgtttacacggaccagccccaataggcgcgcgcccttagcaccagctcctccgtcgtgacgttttccccaatccggtacagcttcttatactccgtatcggcggaaaaacctcccgttctctggtaatagatctcaaactccgttccaatcaccgcctccgcctgttcgctttcatagctgtagcggcccagcacgatgatgtccttcaggccgtccccgtccacatccttgcagacaaggcccttgagcgcatacagattatcatattcccccatgggctggaagctccagacgatgtaaccctgctcattcaccagataaatcataaatacattataatccgccatggtataggttcccggcaccacctgaagcctgcccattttttcaaaattccgccagtagcactgttcttctataatccggaagccatgatccagcagctccttttgcgtcatggccgtatacaggaattccgtggaattgccgtcccgcacaaaggaggtgatgaaccggatgcttttattcatgctgaagcggttgattttatcggaaatccgccagtcctggtagaagccgtccctgcttccgaacaaaacatcccctaccttataggttttctccgggcgggagctgttttcattgatgcaggaggtaatcagcacaatatccgtgtagccgtccccgttcaaatcctggaaggaaaccgcagccatgcctttattgggctgctccagcatgccccggttccggttgttggtttccagtctgtcggttttgtataccacccggtcctccccgtccgtcaggaacagggcaaaccggttatattccgtatctagcgccggaatgaaaatcacttccccataaggctccagcgttaccggaaacgcctgggtatcaatgatcctaaacccctgcgccggaatatcccccagcttgtcaatcgcgtcaaaccgctgcctgtacgcctggtattcctgcgccggctgtgccggatcctcattttctttttccgttcccgcagcctgcagggaaagcggacagcacagaaacactgtcaggaggatacatgcgccccgggccaggcgggttcttattttttcatacagcaagtcttttcacccgcctctcctattccttcctgtccgcttccgccgccttttgaatcagccgctctatcccctcctgagaataggaaagcagccgcccgaacgcacaggctgtctcatagcttttctgctttgtatacccgccggtttcctgcagcctccgctgttcctccttcagccgcagatattcctccagcacatcgtcagtatagtaaaaaaggaaattatatttgccccggttggcctgcgcagggaataactccgtgataaaggcctcgtcttccgggtaatattttaccccgtattttttacaaagcttctttacttccggcagatagctgttgcgttcctgcctggtgtcacagggatggctcatggccagcttcttcactcccgccgccgtcatctcacagaaaacatccattacgcccagctcataggaataccggtcaacctcacgttccccggcggcttcctcatcccatggctcatactcctccttgtccagggaaaggggaatgcccgtcctgctggtcacattcactccgccataccaggtactgtctatttcaaaaatatcgcccacctgatattccatggaaaattcatcgttctttttcactatccttatcttctgtccgctcatatctgctctcctgctttcatccttccccgttgatccgaaatcttttaatcagtcccctgggcagctgcgcctgtgccgaaagctccctgccctgccgcttttctgaccgctttaataattatgccatgtttttcccaacaaaataaatgctatcacttatgctcagttaattatatcatagcataaaagaatgacaacgattaaaaaacctttcccttccgccggtcctgtccaaaacaccgcaactgataaaaaagaagaggcgccggcggctcctctccttttttatcaaatatggtaactattcgttacacccacagttacccaatattaacgtttatccctcagcataacatcatgggctccgccttccacaatgcttgtggaggaaacaagggtgattttggcctttgcctgaagctcagggatggtcaatgcaccgcagttgcacatggtggaacgcaccttgctcagcgtaagatttacattatccttcaggctcccggcatagggcacgaaggagtccacgccttcttcaaaggaaagcttcttgtctccgcccatatcatagcgctgccagttcctggcccgggcgcttccttccccccagtattccttcatgtagctgccgttgatattcaccttcttggtggggctttcatcaaatctcgcaaaatatctgcccaacataacgaaatccgcgcccatggccagcgccagcgtaacgtgataatcatgtacaatgccgccgtcggagcagatgggaacgtaaataccggtttccttataatactcgtccctcgccttcgccacttcaattacggctgtcgcctggcctctgccgatacccttctgttcacgggtaatgcagatggccccgccgccgattccgatttttacaaagtcggctccggcatcagccaggaagcggaagccttcggcgtccaccacattgcctgcacccaccttcaccttgtccccgtaattcttcttaatataatccagggtgatcttctgccattccgtaaagccttccgagctgtcgatacagagcacatccgcgccggcttccagaagcgccggaaccctttccgcatagtccctggtattgatgcccgcgcccaccagataacgcttggaggcatcgatggattcatgctcgttcttcttatgcctgtcatagtccttgcggaataccagataaaccagttcctgcttcttattcaccagagggagacagttgatcttatgatcccagatgatatcgttggcttccttgagcgttgtatcctcgtccgcataaatcaggtcttcgaacttcgtcataaattcgcttaccttcatatccggctccatgcggctgacacgataatccttattcgtcacaatgcccagcagcctgccacccgctttgccgtcttccgtaacggcaatggtggaatggccggtctgttcagtgatccgaagcacatcctgaagcgtcatatccggtgatacgttggagtcgctcaccacaaagccggcacggtagcgcttcaccctccggatcatctccgactgatcctcaatggactgtgaaccataaataaaggacaggccgccctcctgcgccagcgccaccgccagcctgtcatccgaaacagactgcatgatcgcggacaccatgggtatctggatggacaacgcaggttcctcgcccctggcgaatctgaccagcggggtcttcagactgacctcagacggaatgcacctggtggatgaataccccggaactaaaaggtattcactgaacgttctggatggttcctcgtaataaaatgccatatcaactctcccttcctgacagttaaccggttcttatatattgccaaccagcatatcacaccgctcagccgttgtcaacgacactttattacaaaaactcctcccgcatcggagtgaaaatatccagcagaattccctccttcagacagacgcacccatgctccacaccatcctttttcagcatgctgtcacccggattcacaattcttttctcacctgctatctgaaactcaaactgcccggataccacgtaggttatctgggtatggggatggtgatgcacagcgcccctggccccttccataaaatgattctccacgcacatcagcccgtccgtgaacgcaagcaccttacgctccacacccggcgcacaggcctgcgcggcgatatcgctgtttttcacccaggcctgatccttcattgcccttgcatattctgtttctttcatgaaataatccctctcttttccttattaataatgtttataatgttttcacggccctgccggatccccgctattcccttgtcagcttccgaatccagttcccataatgggattccagaaacgccggaatgcatttgaagatctgatccgcattcaggcagcagaccactaccgccggcgaagccttcaccacaaaggccatgacaaatgacagcggtatcacgattccccatatgctgatcagatccatcttcacaacaaacatggcgttcccacctccgcggataatgccgttgttggtcggcatctggtaggacatgccgatcaccacaacgctcagtatgataaggaaggtattggccatctccttggtggaggcggacagatcatacagctgcagaatgggcacccggataaggaacagaagaagccctgacaccaggccgataaccacaaaaatacgctgcagccttccggaatatttttttaccagagcgatatcccccgtacctatcgtattcccgatgatgatggaagcggtggaggccgcacccacagccatggacttgaccatcataaaaatggtggaagcaacgctgtttgccgcaatggccgccgcagtcatatggcccaggatgacggtctgcagcgcggtattcacgccccacagcccctgcaccaccagcatgggcgccgtcactctgaagtaatccccggaaaggacacggtcatgctgcagatagctgcgaatgctcagatgcaactgcttttcctttttgatgatgtagataatcagtaccacaagctccgtcatacgcgccgccagcgtccctatcgccgcacccgcggcccccatttccggcgcaccgaaatggccgtatatcagcacgtaattgattccgcagttgacaaaaaacgtcatcaccgaaaggtagaaggcgattttcaccacctccacgctgcgcagcgtggccagcagaatctgggtgacagcaaaaaagagataggtaaagcggataatggaaagatagcttacgccctcacggatgatgctctcctctgtcgtaaaaatccccaccgcctggcgcgggaaaatactgacaagcgcaaacagcagtatcgcgatcagcaggcccgcatgcatggccgttgccgaaatctttttcattggctccgtctgccgctttccccagtactggctgcagaaaataacaagcccgtctcccagggccataagcagctgctggtaaataaactggatctggttcaccgccgccacgccggacagcgccgtttcgctgtaggagccaagcatcatattgtctgccaggttaacgctcagagttaccacattctgcagtacaagagccacatagatagttaaaaattttctgtaaaatgaagtgtctgctttccgtttcataagttttttctgtttttactttctttttttattattcttacgtattaaaaagaactagggaatagaaaaatatatccactgccggaagggcggcttctcagcctctgggataccgctccttgttccgccttttgcattcatacatctgcgcatccgccgttttgataatctcctccagcgtcatccgttttccaattctcctgatttccactacgccgtagctgaagctcaccggatactcctctttgttttccgccacaaaaagctccagaagctccgcaaacttcttctccgccgtttccttctccacctccggtatcaccacacagaattcatccccgccgatcctggcgaaaatatccgtggagcggaccgaacttttcataagggaaacaaagctgcggatataattatccccctggttatgtccgtaatggtcatttacatatttcaggccgtccagatccagatagcagagagtcacttccctgccctcctccagcacgctttccatatattcatcaaaaaacagcctgttatggatgccggtgcccggatccatatatgctttgctgttcaggcggttggccgcctgcttttcatcggtaatatccaccacgatatgggcataggcattctgcccccgccattctatatggaaggtggtgatacggtaatatccctgctcctcatctcccgcttcccataccttatactgttcgctgtcctgccagttcaaaatatcatttctgaaggaaagcctgtgccggcatttttcacagaactcaggatcgatctgcttttcatcctttctcttgttgcagtaaacaatatccctgttttgtgcatccaccaccacaatccattctttccttctgcgcgtcatctccacaagcagatcattatattcctcaatgacctgcgcccgcttctggaccttctgggcttcctccttcagctgtgtctcccgctccttcagctgggccgtcatggtattgaaggcctccgaaaattctcccagataggaaacatgctgagagtaatccccgctcgccacctgctttgcctgccaggtcagatgattcaggttggcatggagatttttcagattaacgcacaggaaattgtcccgggacggataagccccggacagattgccacgggaaaggtcttccgtatacgcgagcatttcctccaccgcctgctgcaggaatgcaagccccttcccaagcttttgataaggctcgtccagctccttgacatcaagcgcatggatctgctgatcatacagaatacttctcaggtattcaaacagcagctcacaattatccttttccatctcctacctcttctcttccggttccacacggaaccggcatacacgatcccctgtcgcccagcaatcaacctccacggcagaatactctttccccgtataagaggataaaataccggcgataaagccttcatcataattacataccgtttcccccagcagcggaagaccggagcagtccgcgtcctccgatacggtaagcatgatccttcctgtttcttcatcgaatttttctatccgcaggacgccgattttcatctcttccatcttggactgcagcgacgctatgaatgcgttgagcggcagggatatatccagtatgttctccgcgaaataggcgccggccttaaaaccggcctttcggaaaatacgcacctgctcctcttcccccagctgttccgccagctgttcgcgtatggaatattccataagcctgtatacggccaccgggagctgatcccccagatttcccctgtcgttggtattataattcatgtattcagtcaggctgagctttcttttgttctccagaaaaacgttctctgccatactgcctttcctcctctgtcccgtatttttccgttcttagccgcagcaattcaacgcaagctttctttttatatacatttaaagattatatcacaaaagaaagaaaaattgtcacttatacacgtataaaagggaaaaagtgtaacaattcagatgtccggacagttacggaaaaagtttctgcatgtccgacgtgttcaactcataagtttaatttatgattcgataattattaatcattatctatcataagagaagggtgttaaaattaaatcagtaccgctacaaaaaagtccatcaaacatgatacgcagcaagctgcgaggcaatggaccctcacagcaggttccggccagatgttatcacatctatccggatcgttgtctgcgggaattaaggaggtcagcagcatgggttactcgctcaatatcacacaggctgacgcggttctggagaagctccggaaggattaccgcgtcttcgcacccagacgttttcccaagcagggacgttattcggataccgatattgttcgatacgccgaggtggaacgtttttccgacatcgtatgggatgtgaaatcggactaccccgccaaggaggttcttactccgattcaacagactatcttctattttacagaggatgaataccgggcaagcaaggtggccgcaaaaccgattcttcttctggcaaggccctgcgatatcaatgcgcagaagatccaggccaggatatatgcgggcaacggcggctatgatgatttttactatacccggatgagggagctggtaaccttcgccctgatggaatgcggcggcggtgacgatacctgcttctgtgtttccatgggcacgaaccggacggatgattacgccattgccctgcgcttctcaccggagggcgttgtcgtgggtgtggaggatgaaagctttgccccttattttgacggaatgccccaggaagactatacgcctgcctttgtggaggaaaatgaattaaaggtgacgccgcctgatttaagcgatattgaggtgcgcaaggcgttgaaaaagcatcctatgtggaaggaattcgattcccgctgcatctcctgcggcagctgcacggtagcctgctccacctgcacctgttttactacgcgggacgtaatttacggagataatccggaggtcggtgaacgccgccgcgtcagcgcttcctgccagatagaaggctttgatcagatggcgggacagagggagctgcgttccaccccgggcgaccggatgcgttttaaggttttacataaattttatgattataaggcccgttttaaagaaagccatatgtgtgttggctgcggccgctgcacgaaccgctgtccggagtttatttccatctccgcaacggtaaataagatgaatgccgccgtggaagaaatcaaggccgacatggcccggaaaggagtgtgacattatgatgacaaatcccgttcagcccaagccctgcacaattctgggcgtaacaagggaaagcgagcatgagtggaccttccgggtacagtcggatgccaaaccctcgcacggacagtttatgcagctttccatccctaaaatcggcgaggctcccatatccgtttccgcccagggggacgactggctggaattcacaatacgttcggtaggcaaggtgaccgattccatttttcataaaacagtaggagacacgctcttcctgcgcggcccttacggaaaaggctggcctgtggaggaatttgccgggaagcatctcgttgtcattaccggcggcaccggcatcgcccctgtccgttcgctgctgcgcatgtgcgcgcagacgcccggcttcgttccggacatccatctgatcagcggctttaaggatgaatccggcattgtttttcacaatgacctggaagagtggaggaaaacgttccatacaatttatacgctggataccggcgaaaaggaaggctggcgcaccggtcttgtgaccgaattcgtaaaggaaataccttttgcttcctttgacggaaattacgccgtgattgtggtcgggccgcctccgatgatgaaatttacggggcttgagcttttgaaaaacggcgtggcgccggaaaacatctggatgagttttgagcgtaaaatgtcctgtgcggtaggcaaatgcggccattgccggatcgatgaggtttatgtgtgcctggacggcccggtgttcccttatacggttgcccgcaatctggtggactgaggaaggagtggaaaacgatgaatcaagatatagacattaaaaaggtacggctgaactgtttccgccagtcaaaggttccgggagaattcatgctgcagatgcgtgtgcccggcgggatgatcaatgcgaagtacctcagcacggtggaacacatcgccaacacctggggtgatggcaatttccatttcggcacccgccagacctttgatattacgggaatccggtacgagaatattcctgcggtcaacgcctatctggaggattacataaaagaggtggatacctctctgtgtgatgtggatatggacacggttgccggacagccccaggaatgggatccggagggaggctatcccaccatcggcgcccgcaacatcaccgcctgtgtgggcaattaccactgtatctgcggcaactgcaacacctttgagctggccaggaaaattgaaccgctcattttccccagccattatcatatcaaaatcaatatcgcaggctgtcccaatgactgcaataaggcgcatatatgcgatttcggcatcatcggcaccgcccgcatgacctatcacccggaacgctgcatcggctgcggcgcctgcgtccgggcctgtgaaaagggagccacccgggttctcaagctcaacgaggataccgggaaaatagaaaaggacacctgttgctgcgtgggctgcggagaatgcgtacgagcctgtcctgcaagcgcctggacacgtcaggaaaccaagttctaccgcgtgatcctgggaggacgcaccggccgtcagacaccccgtacaggaaaaatgttcctcaactgggccactgaggatgtggtattaagcgttcttggaaactggcagaagttctccgcctgggtaatgaactacaagcccgaatatctccacggcggccacctcattgaccgcgccggctacaaaaagttcaaggagctgatgcttgacggcgttacattaaacccggaatgtctggtagcggaggatatcttctggcaggagacggagtatcgttccaactttaatgtaaaacccctttccatgcaccatactgccggcccccaggaatagggaatggcattgccctaatcataaaaaggccctccggaaactctccggagggcttatttttatcaaatatacggccattcctactctttcaaaatcttttccttaagcagatggtaaagctgctccgggtctatcggcttggccatatgggcattcattcccgatgcggcagccttgaccatatcctcatggaacgcatccgccgtcattgcaatgatggggatcgtagcgctcctgggacattctgcccggcggatcagctccgtggcctgatagccattcatcagcggcatctgcacatccataaggatggcgtcatattttaacggttccatcaggaacttgtccaccgcttccttgccgttacaggcgcattccacttcaattccgctcattctcaacaattccacagcgatttcctgattgagcagattgtcctccgccagcaggatgcagcgtccttccagctccggatgctttatttccatctgggaaagctggaatctcaccgttttgtcaatcccggtggctgaaagcagcacattataaagcatggactcaaagattggcttggataaaaaggcgttcgcccctgccgccctggcatccttctcaatggaggaccagtcataggcagtgatgatgataatcagcgtatccgggcctacaaactccctgatccggcgtgttgtctccacaccgtcgatatccggcatcttccagtcaatcaggcagacgtcatagtcctccccggtcctgtgggaaatacgcaccttttccacacaatccgttccgttaagcacccagtctgacacgatccccagattcttcagaagaagcgaggtatggatgcagctgtctttgtcatcatccgctatgagcaccttcagcgcagccagctcctgttcgccgattgccgtctttttttcttcgctctcagcaatatcaaaatccagttccaccatgaaggagctgccttctccctgttggctgtgcacggtgatggttccgcccatcagggtaaccaggtttttggtaatggacattcccaggccggttccgccgtatttctgcccggtcacagcgctttcctgctcaaaaggaaggaacagccggtccataaactcactgctcatacccacgccgtcgtcactcaccgtaaagcgcagccgcacctttccgtcttttttccgaagctgtctgatttccaggctgatttttccgccctccggcgtgaacttaagcgcattggacagcaggttcagcaggatttggttcagccgcagggaatctcccttcaggactgtttcggtaagatccaccaggggcatggtgaatttcagccctttggccgccgcctggggatagatgatggaggtgagggactccgctacattttccaggttaaatacctcatgggcaatggtcatttttccttcatctattttggacatatccagcacatcgttaatcagagacatcagatgcttggaggaataaccgattttttccagacagtcctccacgcggccgcggtcttcaatataggcgcctgcaatggtggtcatgccgatgatcgcattcatgggcgtacggatttcgtggctcatgcgggaaaggaaattctgcttggccgcattggcattctgcgcattgagcagggcatccttcagcgcctgctggattttcatgctttccgtctgatccgacagggaaataacatagcgcactaccttgccctttacgctttccggatacagctgcagccgcatccatttgatttccccggggacaaagctgattcgcagatccactcccctggaagtcccggaacctgcctggcgctggaattctttgtaggcaggcttatcttcttccaggatcagctgctccatataatcaggggccagatcaaaggcctctttttcaatgccggtaatccgacggaggttggaactgatatattccagattatccttttccttattataaataaagaaaatatcgtccacattggtggaaagtatgtcaaacagacgctcccggtacctgatctcctgtatcccccttctttcccgcagcatcaggcccaggaaaaaagcaggcagcacaatggtcagcagcgccagggatgccacagtcatactggcggtatccgccgataccttttccagtccctgcacctttttatccgcaaacgcaataatagtaatcaggcagtcatttacagcatcatatttaggatgcagcttctcatccacatattggaggatttcctcttcagtcattccggaaacatcggccgcggcttcctcctgcacatcttccagagcctgcatggcctcctttaaggcagccgtatcctcctccggtcccaggtacttctgcgtgataatgcctatggattcttcctgcatttcatagcgctcttccagtttgctggcgagctgttcgggatcctccctggtgtctgccagcagggtggctatgaaacccttcatgtccaaaagccttgaccgcatggcccgcgcttcattggacactgtgtagggatgctcataaatcatggttgcggtattctgcatccgccgtacagacaaaatgccggctatggtaagcaggaccgccaatacgcagattcccgtaatcccagccagcattaatttggaattttttcttctggaaacgttcatggtgctatactcctttgtaggataccctcaattaaaatccgttccttctgtctgctccggtacagcgttgcagtctgatccaggctccggtccctgttaatgctgtactatatctaagcttatctctcagtaaatataacatagaccctttcaaatcacaagggtcacaattattttccgcctttaagtgcaaaaaactgtgtttatttggccggaatggctgattcctttgacagtatccgcaaattcggaaatgaactgaggacggcgggctgttcctttcccctgtctgccatctcattaagcagctggcggaaaatgcatggaaagggttctgacgcaggattattccatgattcccagcttaactcttcttcccatgaaatatgaatatggcggttccccctgcggccggataattccccatgttcagccgggcgttaaaaaagaggctcccgcgactgcggaggcctctctttatttttatatacatctgtcctatgccctgatctcctgcctcataaaaccaatataagacagtgcaaaacataccgccgtcagcgccaccatacacaccagatggggccagacgagaagcaggctctgcccaaagggcagataccccgcaatggcgcctgaaagctgggaattggtgatcacgcctatgctcctgatgttgggatttaaaatggtggccgccgcctccccgaacagataataaggggaaatcctgttcagtcccagctgaaggttataattatccatcatatggaacatgccttctatgccctccgtaggatagaccagatcggcaaccgctcccgccaccatactcatgaaaaaggacaggaaaatccagatggagattcccgccagggccgctgtcgccgcatgtctccacaaaacggaaaacagaatggacagccccagccagaaggaaatataaaataccgtaaaaagcaaaaacgccgtaatacgaagcacttcctcaaccgacggaggaagcccgatggcaagcagtccgatggcgctcaccaggattcccagggaaaacaccatcataaaaacggccgcaaagcctgccataaatttcccgttaatgattgcatccctgtaaatgggctgtgacgtcaggcggttcagcgttcccagcgaacgttccctgttcacacagtcaaaacccaagacgatgcctgccagcggccccaaaaaggccaggaaggtggagatggagggaatggattttcctcctgtggtaaacagcgttaaaaaaataaattcgctgctctccgttgcggcatcacggacactgcccagcgcgccgtaaaggcttgccatgctcgtcagcgtcagaagagccagcatcaaaagaaaccgggcgcttttcagatgatccgtcagttccttgcgaaacagcaccagcaggccgtgcatggagctgttatctctttccgattttagctttgacagcgctcctgatgccgtccctgaaagtctttcttttatctgtatagccttcatactgttcacctgccatttcaaagtatttactgtagatttcatccagatcaccgccgcgctggcgcagcctgcgcatatcatagccattggtaagcagcgccgtgatcactgcagtgtggcagtccctgtccgaatgcacaagaagcattccgttttcccgggtaatccgtttaacgccctccataccggccagcaggcgttccagtgccctgtcgttgggccatgcctcaagctccagcacataattgcctgcgctgcgtagctgtattgccagatcgtttatggagccgcaggcaatcagcttccctttgacaaaaatgcccacccggtcacagatctgctgaatctggtgcagctgatgggaggaaatcaggatggttctcttatcctcttttgccagcctgtgaatcagccccagaagctcccgcataccctccgggtcaattcccaatgtgggttcgtccataatgattacctgtggatccttcatcagcacatccgcaatccccagccgctgcttcattcctctggaataggtgcccgccttccggtctgcggcttcccacatacccactttttttagcatctcctcaatccgcttttccagcgcttccccgtccaggccgttcaggcggccggtgaaacgaagattctggcggcccgtcatatccggataaaagcctacattgtccggcagataaccggtaatttttttcacctgcagggaattccgggtacagtcgaagcctccgatgaaggcagtgccggccgtaggctccgacagccccagaagcatcagggttgtggttgttttccccgcgccgttgggccccagcaggccgaatacctcgccccgacggatatccagaaacagactgtccaccgcggtaatactgccgtagcgcttggtcagcccttctattttaatgattgtatcttccataatcatcgtctcccatacttatggaatacccagcccaggcccgcgaatacacagacaatcaggagcactcccacgatcccccataccgtttccgtcttgacggaaatacggaattccgctgtatctgaggtttcggagccggccgcctttactgtcaccacatagtcgccggacagcgcatcctttccgggtgtcagtctggccgttacttcaacggaggcgcccgcttcgatgacctctaccgcaggctggctgaagctcatgctccatccgtccggcgtggttgctgtaaggttgacatttttcaaatccgtattgccgttattggtcagcttcagcgtaatttccttttgcttgttgggatacgcctcggtgctcagcctgccgctgggcgtggaaacatccagggagtaatttcccgtaatcgtcgccttaagatctgttttcaacgtttctcccgcagaaactgcagagcaggaaatggtataatccccggcctgcgcatccacggagggcgtcacgccgattgtgatcgtctggctctggcgcggctccaccgtaatgctgttcaccgggctgctctctccggaaggggtgaagctcaccgtccagccggcaggcgcattggaggaaaagctgtagttctgctgggacgcgctgttgttcaccagggaagcttcaaagctgaagctggctccggatgcgccctcttgctccggatactgggattcgaagctgctgcttccgatttcctccgccgcaaccttcagctttaatgtaagcgtatcctctgcttccgcgcccgcaaaggcccgcagcaccacctcgtaatctccgctggccgcatcgtccgggatggacagggaataggcggccgcccccgcattgtcgccgctctttacatagacctggctcacttcgcttccattgcctgtaaaataaccttcccagccctcaggaagggaaaccgtttccagtgataccgccatccccgctcccgtggtattggaaaaatccagggaaaagctcagatcatcccctgcatttaccgtcatgcccggatagcccgtgctcatctgcagccctccagcggcggatgctttccctccggcggtaaaaaacaggacagccatgataaaaagggccgttattatctgcgctgctgttttgttctgcgttgctgtgatagctttcataattctctctccttttcctttcggtttatgaaacggcggtaagccgccttttctttgcttccgattatagcccgcgaagtataaatgaacttaaaaaaagatcccgcagaccgccctggtccgcaggatcttatgtgaaagttttgtgaactactgcctggggagcgtcactgtaaagcagacggtcccgtcctcatattccgcgctgatttttcccttatgcccgtccgtcaccgccctggcaatggacaggccgatgccgtagcccccgctcttacgggagcgtgaactgtcggccctgtaaaaacggtcaaacaggcgcggcagctgggaagcatccagatccgcacagggattggaaacccgaagcataagctggcgtcccttctttttcagcgtcagcctcaccgttcctccgtcatcgcagtattttaccgcattgtccagaagcaccgtcagcagacgcaggatggcctcctgctgccccttcatataaagctccggctctattgcggtttccagctgtttaccctgcgcctgcgccgacgtacggaaggtatccgccgcattccgggcagcttcacttacgttaaaaacccgcagctccccggccttccccatttcctcggactttgccagctcaatcaaatccctgatcaggctgtccagccgcctgacctggttctgggtgctttcgatccattcatcctttccgtttacgatttccagcactcccatgttggcggaaatgatgcccaggggcgttttcagctcatgggaaacatccgtgatgaaacgcttctggcgctccatgttttccgcaaagggacgcatcaccctgcctgagagaagcagcagaaggaaaaaaacaatggccacacagcacaggaacaccagcagggttacctgcagcacgttatgggccgactggagctgtaaaaaacagttcagcaccacaatcgtatttttgtccgcctcttcatagacccggtagcggtaatagcccacaaaaccgcttttcttcccttcttttacgatatctcccaccagctcctccacacgatccctatccagggccgcaatgtgctcgatatcaacctctatcacctctctcttttttgtgaggtagacgatgcagtaacgagtctcaaagggcgtctcctccgtaatctggaaccccccggccacattggggacaacggcatccggcagagggaaggcgccgccattgcggtaaagcagctcaatggcagtatccgccagccggataatccggaacaggtttcccagattaatggcaatcccaatcaaaaaaagcgtccccatcagggaaagcattgccgtcagaataaaccttctgcgaagcgtctgtatcatttaaaatcctccgttaatacgccgttaaaatccgcagcccttttatgtcttcctccgcccctttggcttcctctgcccggccggttcattgtccgccctccgcctccagcatgtacccccgcccgcggctggccgttattttcacatcggctcccagggaggcaagcctcctgcgcagataggagatatatgcccataccacattgatttcactgtcgcattcgtagccccagatccgctccataaactgttctgtggaaatgaactgcccctgacggcgcatcagaagctccatcatctgaaattccttgtttcccagccgcacggctgtcccgccgctgctcagctcaaaggtggaacggttgaggcttatattcccaaccgtaagaatctgcggcgtaaaggtgccgcctctgcgggtgagcgaacgcaccctcgccaggaactctcgcacatcaaagggcttgggaagataatcatccgcgccgcagtccagtcctgcgacgcggtcctccacctccccctttgccgtcagaagcagcaccggggtggaaatgccgttctcccgcagcttcttcaggacctgaaggccgtcaagccccggcatcatgatatccaacacaagacagtcacagctctccgccatgccgtaatccagcgccgcctgtccgtcatggaccgtatccaccgaataatgctcatgcttcaggatcgcagacagcgcctgcgtcatttcctcttcatcgtccgctatcaatatacgcaccgtttttcttcccttctcttccgtaattatctttcttcccattgtaaggtcggcgcatttttctgtcaatgccgcgcctggccaggtatggcagccacagccccggccaggcataacagccacagccccggccaggtgtagcagcctgcacagggcaggcgtatgctgtaacaaagccttgactttaacaccgtgtcgtagtttatactgcatttacagggaggtaataaatatggaacccatgactatcagccaggtatcaaaaatcctggggatttccacaagaatgctgcgttattatgaaaaagccggattaatcgaaagccgccggaaggagggctacgcctaccgcatctatgatgaaaacaccgtctgccgcctccgccggattctgctgctgcgcaagctgcgcattcctgtccggcagattaagattatcctgcaaaatcccaatgccgccacagccgtggagatttttcagaaaaacatcaacgaactggacgaggaaatcaccgcgctttccaccatccgtgaaattctcagccgttttgccaacgagcttgccaacgccacagggcttccgctgcagagcctcctggaaaaggacgatattctgctggaatccatcgaatcccttgcccttgtcagcattaattttaaggaggatcagactatggaaaaattgaatcaggccaacatcagcctgtcgcagcccacagatatacgggtcatctacctgccccccgccgccattgccgcagcccactatgtgggggacgagcctgaaaaccacgtaaataccctgcttgacggctttgtaagggaaaataagcttcataaaatcaagcccgatctgcgccgctatggcttcaaccatcctaacccggttgacgaaacaggctatcatggctatgaagcgtgggtaaccattcccgaggatatggaggttcccgccccgctcatcaaaaaacattttgccggcggcctgtatgccgcccatatgattgccttcggcaattttaatgaatgggaacagctctttatctgggcaaatcagagcgaaaaatatgaatttgccggggatatgaaggatcaggagcatatgtgcggcatgctggaggagcatctgaactatgtgaaccatgtggagctggaaaacacggagccggaagatttccagctggatctgctgctgccgcttcgtgaaaaacagccctgaggccgggcagcctatttcagctgccggcagagtcttccgtgaataaagaatatctgtgcttccccagcctttttgcctgatacatggcggcgtccgctttttcgtaaagcgcctggtaggtatcgccgtccgctggaaacgcggcgatgccgatgctgaccgacattccttctcctaatgcgggaagcctggccaggagcgattccgccttctggcaggccaccgcggcgtccccggtgtcgggcatgaagatcacgaattcatcgccgccgatacgccccgtaatatcttcctgccggaattcctttctgataccctccacaagcctggccagaagcacatccccagcggtatgtcccctgctgtcattaattttcttgaaatcatccacatccagcatgaaaaggaaaccgcaccgcacatgcgtcagcagctcttcaatccgttcctgcgcagccctccggttcaatgcgccggtcagggcatccgcagaggagctttcaatcagctcctgctccttggctttcatttcatgcacatccgaaagcttccccaccacggaaagcggcatgccgtgcttatcctgcagcagctgcccctggcagcgcatccaccggtactcaccctccctgttgaggaatcgcagcgttatgctttttgcatgattttgctcaaactggtccgtatttttcagcatgtcccgcagaatttccgcatcctgcggatgcagcagcgtaagaagcgcattcccgtcaaaggggcggatgacatcggccttggggatttggtagcggcttgtgatattcggcgtaaacacaaggtttttggcggcgcagtcataaataaagagcacggtgtcggagaattccgccagaagctcatacctggcctggctgtgcaggattttttcccgctgcctggcatacacgcaccagccgctgccaagaagcagcgccagaaaaataagaagcacagccaccagcaataccgtattcttcataatgggcgccgcatagcccctcacctcattggaatgcgtgatggacaggagcatccagtcattatagcccaaaggagaggtcagcatataaaattctccctgccgcgggcttttgagcaccaccagccgcgtctcgtccgactgcatggcatcgcgcaccaactctacctttgcctccggaattttcatttcctccaaatcgtcatacaggttgtaaagtccctccacatagtcactcccgtccagtatcagctcaccgccgcgccttaaaagcatattgtccgcatgatcgtacttctgtttttccgaggtccacaaaagcaaatccgcgttcagataggcgcagaacacccctgtgaagctgccgtccctttccgccggtgccagaatggaaaatacatagacaggctcctttccgccatgcaggaaaatatcgcttaccaccgtctcccctttttccaggcgattcctgatttcccggccgccctccgttagtccggccgccttcagcgcctcctgcagcccctccgccgggtaataatcaacctcatacaaatattccagttcccgtatggcctccagataggcaccgcttcctccgccctccgccgtatctgtgtacacgtcggccagattctccagcagccctcccgtttcccggatgattcccctgatgtccgacgcctgtccctgatgggtggaggtcaggttttcctctattaatgtgcggaatatttcttcattcttgttctgatatatatgcagcaaaaaaaagaccgccaatcccatcacggccgttcctattgctatcagcaccattccccggtttctcactgctttgtgcagatccttacccttcgttttgtccatatgctgcctctcctgaccccagcgccctatcctacctattttataaccgttcagtttcctttacagttaccatattttctgctgatttcagggcttttatttataaaatgattctattcctttttccgggactgcgcaatcccttcctgtccggaataatattgcgtgcccggaatatttttatctgcccggaatactttcatctggatccgcagcggcagttttttatgtacacggcagttttttgtgtgcgtttctttcttgacacgaacggttctccgtatataaaataaaaactatgataagatgcgcacgacactcctatagatgccgcatcggaaaggcagctttatgaatctgatcctgacttatatccggcggcatatcggtatgtttgccacggctctttttttcctgagcctggaaacgctggcggatctgatgcagcccaccttcatgtcctacatcgtggacaacggggttaaaggacaaagcatctccaaaatactgatgtacggcgcaatgatgctgggaatcgccgccctgggcgcccttggcgccgtgatgcgcaacatttatgccagccgcacctcccagcaaatcagcatggaaatgcgcagcgatatttacaggaaagtccagaccctttcttttgaaaatattgaccggctgcagccatcttccatcattacgcgcatcaccaatgatgtgacacagattcagaatttcatcaacggcagcatgcgcattatgatgaaggctcccattacctgcatcggcgcaatcgctctgatcattctccagacaccgaaacagattcccatgatgatcttaattttatgtatctcctttctgctgatagcggccaatatggggtttggctatcccaggttcgggcggctgcagcgtaagctggaccggcttaatgaggtcagccgcgaatttttatcctccgtgcgggtggtcaaggccttctgcgcccaggagcaggaaggggaaaaattccggagtgccgcagaggattttgccggcgccggtgtatccgccatgcgggtggccgccgtattttcgccgctgattaacctgacggtaaatgcgggcatcgttgtcctgctctggctgtccggcagccaggataacggacagatcggacggctgatggcttcggtcaactacatgacccaggtgcttttctccctgggcatggtttccaatatcctgaatacggccgtacgcgccgtggcttccgccggacgcgttcaggaaatcctcatggaagagcccgcgcagaagcaggcgccccaggccaagtccccctccggggagggcagcgtttccttctgtgatgtaaccttctcctatgcgggtacgccggagccggctttagagcatgtgacctttacggccatgcccggagaaaccatagggatcatcgggcctacaggctccgggaaatccacactggtaaatctggttccccgtttttatgacgctacctcgggaacgctgtctgtggacggcgtggatgttacgctgctgtcccaggaaaagctgcgggctgaaatcgccgtggttcctcagaaagcgctgctgttttccggaaccatcgccgaaaacctccgctgggggaagccggatgccacagacgaagaaataaggcgggcggcccaaatcgcctgtgcggatggctttgtgcaaagctttcccgacggttatgagacgaacctcggccagggcggcgtcaacctttccggcgggcagaagcaacggctttcccttgcccgcgcccttttgaaaaatccgcgaatcctcatcctcgacgactgtaccagcgccctggacgccaccacggaggcctctgtgctctccatgctgcggaaacagtgctcgggcatgacagtactgctcatcagccagcggatttccacggttatgcgtacagatcggatcctctgcctggaggacggcagggtcatgggctttggagcccaccgggagctgcttgacagctgcccggtatatcgggcaatttatacttcacagattggaggtgaccggcatgagtaaggaaatggcgccgccgccctcctccttcggaaaaggccagcgcggcaagccggtggtaaagccgaaggatatgaagggaaccctgcgcaggctgtgggagctgacacagggccagagacaggggcttggatggctgatgctgctttccgcagttgccagcgcgtcaaccatcctctcgcctctgcttatcggaacggccgtaaccgccattgatacgggtaaccccgcgctgcagcttctgatactgctggcggcgctttacctgacggactggctggtacggtttttacagcagttttttatggcggccatcggacagagaatcattcttcatatccgcagcacgctgtttgaaaaaatgaaagcacttccgctttccttctttgacagccggcagcatggtgagctgatgagccgtctgaccaatgatgtggacaatatcagtaccaccatttcggattcgcttacgcagctgatgacatatggttttacgattataggcatactgtgcattatgctgcggctcagcctgccattgacctgtattgcctttatatccgtatggcttatctttctgctgacccgcacgattacaaagcatacgaggaagctgtttgcccaacagcagcagattctgggaaagctcaacggacaggtggaggaaagtatttccggactgaacatggtaaaggcctttggccgggaagccgaaatgacagagcagtttgaggaaagcaacgccaggctctgccaggtggctacaaaggcacaaatctggtccggtttcctcatgccactcaccaatgtaatcaacaacctgaatttcgtcattgtggcggtcgtcagcggtatcctggcggcttacggccggatcagcgtggggctgatttccagcttcctgctgtattccaggcagttttccaggccctttgttgacattgcaaatatttacaataactttcagacggctgtggcaggcgcggaacgtatcttcgaaatattggaggaggaaccggagcctgcggatgcgccggacgcgctgccgcttacggctccccgcggtgaagtggaattttcccatgtcaccttcggctatcaggcgcaggaacctgtcttaaaggatgtaagcttccgcgtgcccgccggaacccgtgtggcggtggtcggctccaccggcgcgggaaaaaccacgctcatcaacctgctgacccgtttttatgatgtcaacagcggcagcatcctgttagacggccgcgatctccggcagtaccggctgcaggatctgcgccgcaccttcggcgtggtgcttcaggatacggcgctctttggcatgagtgtccgggacaatatcagctacggtaataaggacgttttgccggaacgcatccgggccgcagcgaaaaccgccggcgctgattccttcatccgccgcctgccccagggctacgatacaatactcacccagggcggcgccgccctgagccagggggaacgccagcttctcaccattgcccgcgccgtacttcaggaggccccgattctgattctggatgaggccaccagctccgtggatacggtgacggagcagcggatccgccgggccatgctgacaatcacccgtgggcggacttcctttattatcgcccaccggctttccaccatccgggattcagatctcatcctgttgatagaagatggccggatcgccgagaaaggcacccacgaagagctgatggagctcaacggcagatatgccgggatgtaccggacccagatgggggaataggaggcgtctcccccgtccgggaatccggttctgtatcatgccccagaactcatcggcggtaatccatagcaaagttaatatcacgccttccgaatacacacagcccgatttttaggcgcaaaaaagctccggcgggccacgcaatcccatggcctccggagcctccataatctgatacagtttttctattgtttcccctatttcacatcaactgtacattccgctttgctttccacccccaacacgcctatccgcaccgtgccggtcttctccaccgtcctgatccagaaggaggatacgcctccggtaagggggaaccgcgcagggcccagcatcctggcagggccgtccagttggatttccacacattcctgggtaaagggcagcagatttcccatattgtccaccgccttcactgtaatacgggtggcgtcataggtatcgccgtctgcgtacaggacggaatcgtcagccctggcggtgattccggcggcataccggctttctcccacttcccttctgcatacaatgcggtccccaagccatccctccagcaccaggttgttttccgtttctccccagccgcctgcggatttgatcaccatgccgataagccccgatatttccctgttgtaacgcgccgccagcccagaaaggaacacaaaatcctcctgctgcatggcggttagcgtcccttcagtcaccttttttttcaggaatgcagtaagtccccttctgtcttcttcggagaaatcagccagcagttcttcctccatcaaatggaaaatcatgacgggagggtgcttcaaatgggggaattcctccttgcgtggataaaaatccgacacctttttcccatttttataaaccctcacataatcacagttggtcaggatataaaagggcaccatgcctcctccgtccctttccccacggcttaccagcgtaacaggctcaagcaccggttccttctccggttccttctgtgacgcataggcaaaggccgcgtatttggggttcctgaacatatcaaaaacgccgtgataacagattttatcccctgaaccgaaactgccgtgggtattatagtcaaaagcgcaccagctgatgccgcctgccagatcctcccggcccaggctttcgtttatcacccgcagatgccgcagcgcatgttccgtcacccgcgcctcctggtcaaaacgctttgtggggtacatatgtccgttgctctccgtcacaagcagaggcaccgccctgtccagccctgtggtttccttctgcggccggaataccgtttttcccccgtcatgggtaaaatcattataggtatacacatcctccaaaagctcgcttcgctgaatatacctggtccctccggtctgccggcccggatccatggcgcgggccagcgcattggtcctttcgtaaaaggaatgatcatcctgggattcattgatccttacgccccacaaaataatggagggccggttataatcccgcgtgatcatagccttcaaatcctccagggaatgctgcttccaatcctcatccccaatgtgctgccagcccggaatctcctccattaccagcagtcccagttcatcgcaggcatccaggaaatgcctggactggggataatggctggtgcgaaccacattgcagcccagctcccggcgcagaagctgcgcatcccggcgctgtatccgctccggcatggcatagcccacatagggccatgactgatggcggttcaggccgatgagtttgcatttcacgccgttcaggaaaaatccttccggtgtaaaccgggcctgcctgaagcccaaacggctgctgctcaggctgacgcagcttccgctctccttctccttcagctttgcctccgcccggtaaaggaccggatgctgcgtatcccataaggaaatatccgtaagcccttcaagagccgccgggattttctgtgtgccgggcttcagggaaatctctccctcccaattcccggccacgctgttctccggggaaaacagcgtaagctccaaaattccctcccaggcatggtcgcaagtaatatcacatgcgcagcgtaaggttttcacctcctccagcggatcagggcagtcaagccacagtcgctccagccgcaccggccctgcggcgtacagccatacctcccggtaaatgccgccgtaggtcagataatccaccacattcccaaagggagggatgcctcccagctccctggaatccacgcggacgacaagtatgttttcctccccaaagcgcactgccccggtaagctccacggtaaagggcgtatagccgccctcatgcctgcccgccaaaatcccgttgcagtaaacatcacaggccagcatgactccctcaaattccagaaaaatagattttccctgccactcttccgggatttccagcagcttcttatagcagctgacgaactgatattcagtttcactgaaataattcaggggaagcatcttattggtatggggcagatccaccgtctcataccccacggcctccagtgtgcattttatgtcctccggcacaaaatccggtttgtaaagccagttatagttcagcggaattttctgctgcattttcctcctccatttccgaaaggccggctttgcttccgccgccggcctttcttacctatacattcctatatgtatacaataccctattttcagttatttgtcccgttttccttttccgccctgcgttccttcagctcggctacaatcttcgcatggcgttcctcagtcagagtatagaagaacataggaatcgccccaatcatcataacgatgccgggcaggaatgataccacaaaatgaaaggcattcatggtatgttcggtctgctctacattgggcacatagcctgtcatggacagaaccacggcaacagccacgcctaccagcgcggaagcgattttggtgatgagggtacgggtggaggtgataacgccttcgttacgctggcctgttttccactcgccgtattcgatggtatccgccgtcatggagctgataaccacgaaggccgcccccacgaacagaatctgcagcgcgcccataacgagcaccagcgtgatgttgtgatagcctaccagataaaaaacagcgcttaccgcaagattggctatcatcaggcccagcaacgtctttttctttcccagggccttcgtcaggaagggagccgccacggtccccagcaggatgctgggcagggtgatcaggctcattaagctcatcagcttcacatcccccaacgtataggtggtgtaataataattcagtgtcattttcatgataaaggccaggttgattaccagattggtaatcataatgcagaacagcggcttattggtaaaaagggatttaaaggcaagcgcaaagctgaatttttccgtaggcgcttccacatgctcccttaccatgccaaagcaggtcaggtacagcacacagcccactaccgcgaagatcagcgccgtcataaaataggcatgggcgcttcccgtaccgccgaaggccacaagcaggatagggataagcatgttgccgacggtattggcaaggttggtccccagggtcgccgtggtgaaaatcttggttctctcctccggatcgctggtcatggccgccggaaggctccagtagggaatatccacgctggtgaaggccattcccataatgatataagtgattgccgcataaataatatttcccgtaggcccgaaattaggtacggtaaagttcagtacaaggcatgccgcaaccaccggcggcatacgcagaagccagcagcggtagcgcccgaaccggcttttggagcggtccgcgataattcccatcatcggatcattgatgccgtcccagattctggcaaacaggaaaattcctgccataattgccgggttcatgccgaatacatccgtataaaaagcggtgatgaagccgctccagagcgcataaaccgtattttgccccacgcctcccagcgcatgtcccagaacctccttgttggaagccatatttttccgcttggccggtttggtgtcagccacgccgtttccatttactgctgcagtttttcccatgagttattcctccctctctattgtttaatgatattccggcagccaactgccatgcgcctctatcagctcatccaccaggctacgtatttcgtcaatcgtcagctccgacgccgtatggggatccagcatggccgcctgataaatggcctccctgctgccggtgagcgccgcgtccactgtcaactgctgcaggccgatattgctcatattcagggctgccagctgatggggcaggcttcccacatggcacggctggatgcctccctgcccggctgcgcaggtaacctccacacagcagtccttcggcagattgtcaatcagcccctcattcatcacattccctgcaaaggtaaacggcctgcccgtttccagcgcttccagaatgtaggacggatattcatgcgtgcgctggtggatcaggttttcatcattcaccagactgtttttcagttgcttccagtgttcaatctggatgcggcagcggcgcgggtattcatccagcggaatctggtacttttcaatcagttccggatgagccttcttgatgaaataaggcataaactccgcattgtgctcactggactccgtcacatagcagccaaactgcttcatgatttcaaagcgcaccagatcatcgtgtttgtgcggggtgaaatcatattccggataaagcagctgtggataatccttcagcatttccctggtatacggtttgaggatcggcccctcttcggccctctgtttgatttgcgggtaataatcctctccgttgcgcgtgatttccagcagccatgccatatggttgattcccgcaattttgtacttcacatgatcctggggcagccccagcctgtatagcagctgcggcacacagacctgtacggaatggcagattcccaccgtctgtatgaaggatgccctgcacatcgccatggtcagtattgccatgggattggtgtagtttaaaaacagcgcatccgggcagaccttttccatatccctgacaaaatcaagcatcaccggaatggtgcgcagcgccctgaaaatcccgccgattcccactgtatccccgatggtctggcgcaggccgtattttttcgggatttcaaaatccgtcaccgtacaaggctcatagccgcccacctggatggcattgatcacatacctggctccccgcagcgcttctatgcggtccgtatattttacgatccgcgccctgccaccgttagagttccggttgatgttggacagcatctgccaggactcctccagacgctgcatatcgatatcgtacagcgcatattcaaattcctgcagcggccctgtcagcatacagtcccccagcacgtttttcgcaaaaaccgtgctgccggcacctaaaaatgcaatcttgtccatagtcccctccttctttgttttgtgcatttcatacatacaatatagcagtcgttttgcattctttcagtaacatgaacagatgcaaaaagaaagagcggttaccatttcagacttcctgaatagtatccgctcattttaacgacatatgttattcaattttcccatgccttccgataggctcccggcagcatgccgtatttttctctgaacatccggttaaaatgccccttattggaaaaacccagctccctgatgatttcattcacactcttatccgtggccttcagctgctccgcagccgcctgcaggcgcataaaacgcagatgggaggaataattttccccggttttctgcagcaggaaacggttgaggtaatccgggttaaaatggaagaaggctgccagctccgtccggttgaccgtatccagatgctcctgcatatagttcagtatttccgccagaaggttttcttcgatttccttccggctctgatagtggcaggtatagccatggttttccgccagaagcccgaacaggcggaccagataccccttgatcaccagatgatgtccgggcagctttcgttcatcttcctccacaatctgttccaaaagcccctccaccggggaaaaatcctccctgtggaacagaatatactgctgatccgtgcgcccgaactgattctccataaacgccgcgatctccggatgcggggcaaaaaagcgagccagctcccctttcaggaagcctgcggacagccccataaacagcaccctgtcctccggtcctgacacctcgtccctgtggatcacattgggattgagcatacatacatcccccgcctgatgccggtgcagcacgccgttgatggactggacatagcttcccctcagcacgaaaataaattccatataatcatgtctgtgatagctcagctggtagtgggcctccccctccccgccgaaggaaggcgtcgcgggattcaggaaaaaatcccgtttgatgaagttcaccttctgttcctccactatcccccgtaaaaaatccacgctgttaaagctctgcatcgtatttaaccgggagatatacgcggaattctggatccgacgctccagttcctctttttcgtcctcctgcgcaatccggtactgccggaccagacgccccatttcaatggccggcgcaaaccaggtttccatatccatagcattcccctccccgtcatcgatagctccattttagccgaccgacggtacatttacaagaggggcgccttcacgcgatacttcacacaggatttttaagccgttactcagccgccttttttactgtttcagatttttttcataagcatcataactgccgtactgcctccacagctccatcatcatttcataccgttccagcggcaggcctgtgtaaacgcagttggaggtggaaaaaatatatcccctgcccgccgccatgccttcccgcagcgcgcgcagcacatccgcgcggcattcctcatcggtgcccgtctgcagaagcccgcagttaacgttgcccacaagcgcaatatccggccccacaatcttacgcacctcagggatggaaacgcctccctggggatccagggaatggatggcgtccggccggcagtcagcgatctgcttcagaatcggcatgatatttccgtccgtatgcttgatggtataataccccagcttccggtactccgcaatgacctccttcaggaaaggccctatcagttcatcaaaggaatccgggctgaaaaacggattcacattaaagcagtaatccgagcaaagcgcaaagccgtccagaagatgccctttttcatcaagctttgcggcaagctccagggattgctctaccctgattctgctctcctcattcagtttctccggctcatcaaacattctggccgaaaattccatcatattttctccgtcaggaatggcccaggtggggtcgccgtgcatcattatgtaatattcatccccgcttttttcccggatcagctccagcagccactggatattctcaacgtcccctggattgggatggataaaaatagcgctgtggccatatctttttgccgtatcgatataaagctgggccatttcattcatatgaaggctgcgctcccggtaactcatctggttccactgctcataaaaacggtgggagggatgcaccttgccgaaggcctccatggtcaggaaaaagaccagctcaaaggtgggcacctggccgccgatgggctcgcattttaaggtccgtataaatctctctctgttcgtcattttataatccccatttagtagtaaaacgcttgtaactgtgaaggaatccaacagttacaagcacttttaaaaaagcattccttccatataacattctttgaagaaagcatccgacgccagatccacagtctgtgccgccgctgccagccgctccgcctccggcagcttttccttatccagcagcagcatagccgctcccataagcgccgcatttcccgtcaccgtaatttttcccaattccacctccggcaaaagcccgatggcaatcgcattctccagatggatgaagctgccaaagccccctgcaaccaacagctcctgcagctccggcagctgcatgcccgcccggtgcagcatggttttgattccggcacagatagcgcttttggcaagctggacctttcttatgtcctcctggaacaggcggacctccccagcaatcaccgcttcctcatcctccagatagccggtttcatccagctcctccgtctgcagcaggcagctcactgcatcgatgacgccgctgccgcagatgcctatcggctctttatcgcctatcacctcagccgcaagcccgttctccgtcacccgcacatgggcaactgcgccgtccgttccctgcattcccatcttcagccccgccccttcaaaggccggacctgccgctgtggaacagcagaaaattccttcctgtctccacagcacaatctccccattcgttccgatatccacaagaaggcggtcatttccgggcttttccgtccgtacgctgagcatggccgtggtaatatccgctcccacaaaagcggacacgcagggcggcagccaggccctcgcctgtaaccccggcagacccagctgctccgccgtcagccattcccccgccagccagtccgcggcaaagggcgcatgggaaagggcggaaggatcccttccggtaaaaaaatagagcatggccgtatttccggtcagcaccaaagtatcaatatctgccggggaacagccgcctttatttgccagctcctccaaaagggacgtcagccccgatttgatacacagggccagcgcctcccgctcccctgccatgcttttttccatccgggaaatcacatccgctccgaaaacagactggggattatccgccccggccctggcccggaagccgtttttatcaaacagcaccgccgccagcgtcgtcgtaccgatatccactgcagcgcccagcccttcaaacaaaggcctcacaggctgaagccccaaaaacgcttcctccggagtctggcgcgtagcctcctcttcaaaggacacctcacattctcccagcacccgggtacgacaggcaaggcggatgccgttttcacgctccgccctggtaagcttctttatttccgtttcatccggttcgctgagcagccctgacgcccggactctgcatttgccgcagattcctttccctgcgcagggcattttcagtcctccggcttcccggaggacatctgccagcaccgttcctttttccgtctgaaaaatccggccgtttaccgttaccttttccatgtcctgcatcctcatgccatccgctttttttcgtagaattcctgcaccgcttcaaaaaaggcgtcgatattttcccatttggacagcggcgggatatcacagccggaggaaatgacaaagttaggatatttgcagcaggcctccataatggcccaagtctcctccctgatgctttccggtgtcccgttccggaactgtcccgcaggatcaacatttcccatggctatggtatctggcgggatatgggtcatcatttccgccatattgatggcgttgccgaaatggtaggccgcggcacccgtatccaggatggaatctatcatctggatggtgctgttgccgcagttatgataaataacaaggaaatcatccgtctgaagcgcttccacgatccgtttgacgtaaggcgcagaaaattcttccgcaagcgccggtgagagcaggcctgccagcggttccgccattacgatgccgtccgctcccgcttccttatatgcctgtccgtaggcaatcaggaattccgtcaccttatccagaagctgctgcaccatttccggttcatcataacaataaaacatgatttccgtcacatctaaaagccgtcccgccagggagtacggcccgataatcccggcaaacacgggtctgtcttctatcatctttgccgctttcttaatggcgtcaatgtaaatctgcgtccttccggcgccgatttccggcactgcaagcgcttccacctcttccggcgtggatacgacgctgctttttaccgtcggcacctcatcatcgcttacggaaatcggcgcgccgaagcactccgcctccaccgaaagatccatcaggctcaccgctgccgcggcgtctgtcctgtccgcaaccagcttcattccctgcgcctgtctgtcactgtcggaaatcagttcccttacgctgattcccatcagctgcacagcaggaaaggataaaacggggagcgcctttttttccggcatttcccttaactgcgcaagccattgcttcatatttctactcatgaactccatcctcccggttcccggctttatgaaaagaacacggcgccgaaataggttaccgtatccttgccgttgatatagcgcattccgcactgcgcagccagcgttgaaacgttgattccataggcctccagggaagacattgcctgctccggatgcctgcacgggtcgcctgtctttttaccgcagacgtcacacaccctgcagccgccggccccaagatgaagcgtcttctcacagtcaagctgttccgccagacgccgcacctgctgcgccaggtcattatgccgttttccggcctccatcattccttcaaaatcgtagctgtcttccagcgttcccactgtctggtaaacaagggcgagacgataatccttcagtctgcccatgagggtttccacctctcccacatcgggcgggcacatgtaactcctgccataattgccgcaggcgttggattcgcacagcttgcggaaggaagcatccgcctcgatccgttccgtctcaataaattccgcccggtaagctcccaggcgcagcacttcttctctcaatgcttctttttccatagttcccccgctgtctgccgttttccttaacctgccaggctcctgcagatttccacagcagcatccgcagcgcttgccgcatcagctgtgtatttatcagcgccgatctgttcgcagaaggcttccgttacaggcgcgcctcccaccataatttttacatgatcacggattccggctttttcagcttcttttaccacatcgctcatcactgacattgtagttgtcagaagcgcggagcagcagatgatctggcagttctgggaaaccgctgtttccacataggtttcaggagatacgtccgttcccagatcgataacctccaggcctttgccttccatcatcatttttaccaggttcttgccgatgtcatgcaggtcaccgcgtacggttccgatgcagaccctgccggccgaggtattgtccccgtcagctaacaaaggcttaagcagggaagctcccatattcatggcgcgggccgccacaagcacctccggtacaaaaacttcgttatttttgaatttttccccgataatatccataccggacagaagtcccttctccaggatctccttcgcagggattccttcatcaatcgcctgctgtaccagttcctttactatcttcgctttgcctctctgcagattctgtgaaatttcctccaagacagccataaaaaaaatcctccttactgagtatgactacattatttgccctgattatagcatcctccttttctttttccttgtagttattcgcccgttttggtaattttccgacctgtttccttgacataccaaaaattcacgggcataatgcagatagagcaatattgcaactatggatggatcgaaggattactttgaatttataaaacgatcacttaaatttatagaacaattacacggtattttacaaaggaaggcttctttaatggtgcaggatacgtttgatcacaagctggcccaggagtgcgcacgggctttttcggtgtccacagggcttggctgtacggtttcggatacggccggacatattttttatgaacatgggaagggatgcggaagctgtacgctgtgcgaggcggcggggcttccccatgagaactgtatccgcgcccataactatggaatgactgaggcggagcgtttcggcgggaagtatatttatttctgccccctgggactgacctgctttgtctcccctatcatcggcgaggtgaaaagtaccgccaagatcaccgtggggccgtttatgatggtggatttccaggactttatcgactgtgaactcaccgacaatctgccgctcactcaggaagcgcgggcggagctgatccggcttcttaaggaggttccgcagatgccgcccacaaaggtgcaggagctgtctgttcttctttttatggccgtcggcttcatgaataacgtctccgctgaaaacaggcttctggaggccgaacgctccgatcttctgcaggggcagatcagcgcctatatctccggcctgaaaaaccaggacgccccgccccgctatccttttgaaaaggaacgcgccctgctattgtcaatctcacatggggatcgggaaagctcccgaaagcagctcaaggaactgcttgccgcccttctggcttccggaggcggacggctggactggatgaaatccagggcttcggagcttatcgtcatgatttcccggaccgcggcggaaaacggggcggatgaagaagagacgatgctctttaaccatatctgccagaaaaccatcccctccctgggcagcttcagcgccctgagcaactggctgtaccatacggttgaccgttttatggacagcatccagtcctaccctgacgccaagcatgccaatatcatacataaatgcatccagcacatagggaccaactatgcggagcacctgacgctggaggataccgcccgcgccgtttccctgtcccccgattatctgagccgcattttcaaagaggaaaccggaaccaccttcaatcggtatctgaacaatgtgcgcatcaccaaagccaaggagctgatccgccgcggagaataccgcctgacggacatttcccagatggttgggtatgatgatcaaagctattttaccaaggtcttccgtcgcattaccggcctttccccaggggaatacgggaaaaaaacgaggaggatccaggctcccgagaaagcctgaatccccctgctataattacttaactgtttgtcggaatcactcatccttttttacggaactgcttatctgttttgctgaaattacttatccgtttccaccggaatccagagctcgcaccggtactgcggcgactgcatgtcgccctgcgggtatacctggatatccatgccgctaagcggccggtattcgcttccggggaagaactcggaatatacttttttctgcagctcctggaatgcgccgggcatagggtctgtgccttcaaaaaccacccaggtgtttgccgcgatccgttccacactcagcccttcccccaccggctccccatgatagcctgcgcctatcgcataagtgatttctttctcctgtgcattctcactcaggcacatgccaatcaaggcatttccaaaaatatcctccgccgcctgataggcagaaagcttatccagcgtctgatcccgcctgcattcctcccagaatgcgggcagctgcctgttgttttcctccaaattatcggaaaagttcctctttctgacaattacctcaatttctcctcttgtctcaaccctgtaattcatcgtgcttcctccgtctaaaataagttttacggaaagacgggagaaggaattcagctttgccccgctcagcctggcctgtgacggcgtaatcccatgaaatctggaaaacgccctgccaaagctgtccggagaatcgtagccatacttcaacgccacatcaatcaccctgcatttcgtcgaggcaagctctttgccggcaagagtcagcctgcggcagcggatatattctcccagtgtacagccgcacagaatactgaatacattctggaaatgatatggcgagtaattggcctggccggcgacatccgcatagctgatgtcctccgtcagattatcctccaggtagttgattgccttctgcagatcgtttatccagttcattttctcatctcccttccgtatgtacctatcatatcggagaactgtgttttcttcctgacttttaatgcgatggagtgcaggatccatgctataaccggagacctgcggctgggacgcattttcacggaagcttattatttccagtaacgttctacaatttcccttgcagatcggggctccttatcgaaccgtgtttccaccttttctactgtctgctcaaaggtaaggcccaactcctcgcagatttctattactacctgcagcgcctgttcgcgtcctttttcaatcccctgttcgattccgtcattaatcgacatttctcctagcagtgtcattcttataacctctttcaccttagctaacttatttttatccagaaaattatctgcaaaaatatatagaaacgcttgcattttttccagctccaactgggttatgggcgcttctgccgtatgcaggattttcaggctttttataatccgctccccgatttccagattccctgacatcaggggtgtcagcaggagcggtacaagatctgttttcgtcaataccacgccttttgccctcttttcttcgatagcattgaaaaggcgatccgcatcctttcccttcaaccggataacttcaacacggtaagtattaatgcccgctttcagctcacagagcagttccttaacatcggcagaacagataacataggtaactatgtcaaccttataggctctgctggtagctgcttcatattcccggaagcgtttcagatcctcccgggtgatttcatcactttcaaattccagatgcacccagttaccttccttcattgcataattaaaatcctggtaaaactgtctggtctccaatttaacagtttcggtgggggcaatatattccacctcgccccggattcccagcaacggaagaagttcctcccccaaatactgcgccgccgttttcatggccagatcctcatggtgccagctggtcttttcagcctgttcaatgttttgctgtgaagccagggcctatccctgctttcgctttgaagtttttccttctgaagctttttcttttaaagcttttcctttcttcgcttctgcttttttctcgtgttctttcacacagcctccgttccgtaagctatgtataaaatcctgtctgtcattcaattatagctgttaattcgacaccgggcaaccgtattctacatttttgtctaatatttttgctgtaatggttaaacatggaattactgaattttccaatttgtcttatgggattactttgatttataaatggaatcttgtatccgattggacagaaaaacggatgaattcggcactataccagaagcagagcagtaaatgcagatggaaatcgtttacacaaaaaagagggttttcaaccgaaagtgtgaattgaaaatcctcttttttattccgtctgttttttcacagccccttttccaataatggcgtcctattttttgactacaggaatccaaacttcgcagcgataatcggaggccgaattatccccctcaaaatacacttcaaggtcgggggttcccgcgtggctgtagataccctgaggcaaaaactcagaataaatcctctgccatacattttgaatcgcctccggcattggacccacggactcaaagattgcccatgtcgatttgggaattatcagctcgctcataccatcaggcacaacggctgttgtctcaataccgatcatgtaattaaatgttccatcgttattcatgttgcagcatataccaatcagcggcttgcccggagatgttttgcagagtttttccgctgtgccgttttcataacactctccccaaaagtccggtatcggattattttcctgcgatgctttaatgacaactcctacggtgcgaatgtcctctttttcctcaatacgataattcatttccgttactccttttacaagtagtgtaaaggtcagacgtggatatgcttttaaactgacgccattctcttttactgccgcagggttgatgccgtgcattcgtttaaaggccacggtaaacgcatcggcagtttcgtatccatatttcatcgcaacatccaccaccttacagtcagatacttgaagatcatacgctgcaagtgtcaattttctacgccgaatatactctgaaagcggaataccgatgattttagggaaaattcgctgaaataatcccgccgggcatgcggttatgcgtccaatctcatctaagtctatttcatccgtcagatgagattcaatatagtcaaatgcctcattcatctgtgtcagccaatccatatctcccgtcctccttccgtattcagtctatcgtatcgcagcataatacgctcgttaattcatgctcattatttgacgaaaaacgtgtccctttgccagccccctttaagctcagtctcaaatatctataacatggcatgcttttttcaacgtttcaagcaattctgtcagatagtccgcaatttcataggcatccacatgctgctgccttctgtaggatgcaatcctggcagtaggcggataagccatggggactaattcccctgcctccaacagattggcaatatattcacaggcttccagcagattttccacatcgttactgtgatcaaatccctgattctgccttgcggcatgcagggttctttgcgccagtatgcaggctctcctcacataatcctcctgattcacatcagaacggacggcactctcgcccctgttgcggaaaaagccggagatagcggaaacaatggaaggatcccggatcgtgccatccggataaaccaccccatgtacgcgcgaccacatatcttttccaatcatcagttcaaacagataccagccagtctgatattcgttgtgaagctcaatagacatatcataggggttagctcttgcaagacagcacatttcgttatcgagtacgggcttgccatatttttctcccatttttttcgcatactccagtgcttcacgtaaacgcttacgggttgaggaataatcatggaacacaattacatcgaccagctcagctgttttgctggcctctgtttcgtaaataaaaatattgccaacgccgatatcatgatccggatccttacttttcacatatttgcagaaatgccggacgatttcccaggttttttcctgcctgtaacggagtgtctccatatcgggacgttcctgataatcctgcacataagcaggttcctcgtcataccatgttacaaagttgtctgtatatccgggctcatttgcaatatcccagaacagaagtccttcctcctgaccgattgcctcgtaaagtacgtcaaagtacctctcgccgatttgccagctggcgggatcctccagcgttttataaatcggccttaaccctgcttctaacataaatccaccgggcgggagctcatcctcccgaaaccggaaccccataaatataatagggtttgtagaaatgccatgtttccatgccgtctgtacaaaatccttcacattggcaaggaacctgtcgggattttccttgtaaaaatcatagctgagaaaaatccgggcgctgttgagatgaagcctctcagcataccccatatccctatccacgatatcatgatggtaattagcccaaaaatccctgtcattcacagcatccggctgtgtatagttgaacccacgcagtttctgataatcaactgtctttttcatcatagctcctgtccgtgcaccttatgcactcatacaatcatacaatcaaagttacatacgcttcatcatcctttgactccaccaagtgtaatacctttcacgaaattattctgaacgaaaggataaactaccaatataggcatgacacccgcaattgccattgccatacgcacggaaaccgtagggaggtctgcaagcaaagctgcggcattggaatctcctgactgggtcagatactggatattctgcacaatccggttcaacagattctgtatggaatacaaatcctgacgtctgttcaaatatacatatccgttgttccagtcattccagtaggcgataccggcaaacaggccgattgtcgcaataatcggttttgctaacggaacaactatccgcaggaaggtctgggtctcagatgcaccgtcaatatatgcggcttccataatctcatccggaatactggaggcgaagtaggacttcatcagcaagatattaaatccatttgttaccaatccgggaactaacagtgcccagaaggtatccttaatatgaaatacgtttacgtaattgatatatgtaggaacaaggccgccattaaacaacatggtaaaaaatatataaaaagtcatgattccttttccgggtatatcctttttggaaatcgcataggccagcagggtcgtgacacacaatgaaataactgttccaactgcagtcagttcaaaggatatcgcataggccttcagtacctgcggattttcaacaaagatataattataagccgccaggctgaacttttcggggaaataactgtacccgttacgaatcaatgtattattgtccgttaaggaagaaataattaccagcaataatggtgccaccgccaatattgtcataattatcataacaatatttccgataatttgaaagcgtttttcatcttttgatttcataatttcggcctcccttagaatagcgcgctgtcaggatctattttacggaccaccagatttgctgacattacgagaataaatccgacaattgactgataaacaccagccgccgtcgccataggcatgtcatttctttcaagcaatcccctgtatacataagtatctatcgtctgtgtcacagataacaaaataccgcttcgctggggcacctgataaaacaggccgaaatcagaatagaaaatacggccaatggcaagcaataccatcatgataatggtggctttgagcaaaggaagcgtaatttttgtaatctgctgccatttggaagcgccgtcaatggaggaagcttcatatatttccctgtcaaatcccaaaattgtggacagatatacaatacagctatagccaacactcctccaggtctgaacgaacaccaaaataaacggccagtacttcgtttctgtataccatggaaccggatcaatgccgaataaaggaaagattctggtattcaaaaaaccatgttccgcacttaaaaaagcaaataccagataactgataattactgttgacaggaaatgcggcaacagaatggtggactgatatatttttttcttttggttgtaagctctgacagaataattgcaactgcaaccgctatgagcacattaaaaaatatgaataaaatattatagcccagcgtatttctcgtaataatccaggcatcctgcgttttaaaaagatatttaaaatttttaaatccaatccagggggagccccagattccttttttggtagagtattttttaaatgccagaaccagacccggcaatggcatataattgttaataaacaaataaataatacccggcagagccataatatatactggaatataccgtttgataagctttaattttttctttgaattccgtcctgcttttgccgtctgttccatagtacgccagcctttctttcaaaaaaggaataggaatctacgatttctatccctttttctattttttcattttacagaggagcccgttccagcagcccctctgatgtggtcaaccgcagattattcaatgccgttttctgccgcccacgcattcagtgcttcagtcttcgcggcgatataagtttcaattcccgcatcctccagtctcttattgagttcaggaattcctactgccggatcaatcataccgaacacaagtccgtccgcatattcagtccatacattggttaaagcagtatactccgcacttacttccgatgaatcgaagctaaagcccagcgctttagatttcatggcattgttattaaattctttggttttttcccaaaggtcaatatcatcgccttcccatacataagtggtatattcacaaggcagcatccatgcaggaagcatattgtagtaatccgcattatccttattgacgccttccgggaaagttgcatgaccatcctcggtcagaacatagtcttttccttcttcaccccagagtaacaggttggttactaccgggctggtgtacagatcattcaggacaaccatggcagcctccggagcttccgtattggaattgatgctccatgatgcagcagaggcctgagaagagtttacgaaattctcacccagctggaatacgatagattccaaattaccgcgttctacctctttctgacgtacaataccaggctttccggcagtagcatcacacatcagtgtacctgcaataatctgtgcgccgccattctgtgtctcagtaacagcatccttggagatatatcctgcctgctgccatttatacatcaattcgcaatactccctgaacaaatcactggtaaacagatttgatacttccagactgtttgcaggatcaagaagtacgccaaagttatcgccgccgattggatcatacaggagcttctgattcagatagccatgattccagggataaattacgtttacatccgggtaagcctcatgaagctgtgcaaacagctctgtcatttcttcttccgtagccggaatacattctgatgtatttacaccagaaaaatcatacccgattccatccagatattttttatcaaatgcgatacaccacataccacttgccaggtctctcatacagggaattgcgtagagagagccgtttaccacacaacctttcaggaaggcaggatcaaccagttccagaatatccttaccatatttgttgatcaaatcatcctggtaaagatcgtacgcactttcattagatacagtatttgaaaatcccattacaccagaactgaaaatatccatctgttccccggaagaaagcatcatgttgatagactgtgcataatctcccatatttgcagtcacaaactgaacatcgatgttgtaattttccatgtaatactcattaatctttttaaaaattctatcttttccaggtacagaatcatcaccacagtacaggccgactacaactgtctcaccgccaaaatcagtaattatatcttctgcagctgcttcttcgctggcaggtgcagcaacagcctcgtcttccggagtatctatctggggtgtctctccaccgccgcatccggtaagaaggctggctgtaagcattaagctcatcaggaatgcaagtgctcttttcattattaatcctccatatcattggttatcaggaactcttatcgatcgatgatattattataactgtaattaaattcaaaataaattcacaaaccttagcagttattacaatattctgatatcttctcaatcaatacaagcaataatattcctgaagttttctggatacctcataagcaaatctccgaacctgtgcccgatcacgtttttccggcggattatccctcaacgcaaacagcctggcagataataagtcatccatcggaacaatttcacagcattccaggatattcacacagacttccgccgcatccaggatttcatctgttgttgcctcaaacttggtgaacaggctctgcttatccacagcaagtgctttttttacccgttccacagctgctgtcgcatattcctcccgatttccctgaggaatcacccttccgtttcccctgtttctgtaaaatccaaacatggcagctactatagaaggatcacgtacagtaccatccggatatacaattccatgaagaggcgcccaaaatccttctatcacaagattaaaaatataatacccataatgaaattcctcacagaactgcaattccacatcatagggattagcccgtccaatgcagcccatttcattgtttataaccggttttcccccctgtgcttttgcacatttgccagcatactcatacacttctttaatatccttccttgtggtcaggtaatcatggaaggcaatgacgtcaaccagatccgctgtggaatccagatgctccttcagttcatgtcctactgtaataggcgtatcatcatccagttcccgaaccatctgacattgaagtctcagatcatgctcaatttttttgtaccgggattcatattcatcagcaggacagtttctcagataatcgttgcaaaaaggttcattatatacatcccacatcagtaaatttggttcatttttgagcgtgcggataatcgcagaaagatagtcacgctttctcgcccattcctcagccgtcaatagctcataactgtggatttgattgccactggaaaaaatgggcatgacactgatcccgtgtgcaacgcaaaggcgcgtataatccagaatcctcttttctgtcatatccggattcttataccagtcttcctccctgactgaggtgcggacggaattgatgcgcagcctctctgcatatccaagttctctgtccaactgttccatagatataccttctctggggccatgatggacgccgcggatttcactgtaatccgatttcactctgtctctccagcttttcatatgttcttttcctccattcattccaaatcattttttcctgtttccttcaataccttcatcaattcgtttctgtaatcagccatcacacctccctgcccggccgaaggatttgctgtgaatcagccgttttactgatttcagggttgaatttcccatatctttttactattatattatagtaagatatttccacaaaaactatgtacgcatcttaggcactgtatcaatattcttacatattgcgcagactataccactgaaaccggggacagcttccctcagggtaccggtcaaaggaggaatctatgttttctcataaaaagaattattccctttttgcccaaacgaagaaaatcctgcttctaatatacggtctttttctgatctcctttaccgtgatttttctgtttttaaatatcaatatgcgatccaatctgtatgatacccaccacaaggctatcaattactgtctgtcggagattgaaaataatttaaaaattgccagccgttccgtattgtctgcactatacaatgatcctgatttatccgaactctcctgttcagataataagctggccatctctatcagcgaatccagtttccagaggactatttcttcctacctgctgtgttactccacagtggacggactgtttttttacagcgaacgtaatgatcgttttatttctaccgcccgggagtctgattccccgttccctgcctatttcaggaacacattgcggatagttgactattcctccttttataaggaaatccccgaaaaatatgaccggtataagttctgccaggttaacggcaggtactgccttgtccgtttttttacatttaacaataagattggcggcgtatggattaatctggatacgattctaagaaaactggaacagagttcctccggagatatcctctttgcctttcttgacacggtggggacagctctccccattacaaatcacgacgctgacactgataccctgaaataccttcttgaaaaggatgcaagaattataaactatgcaggcaaccggtatctgaagtttcagacaagcccttctttttgccatgaggatttattgattctgatgtcttattctcagatgcagcaatcactggatctgcattatatgctgcagggaatttttattatctttctgaccctttgctttttcgtcacctttattctgttccgcaatcgtctgcagatgcccatacgcgaactgcacaggatatcggcgactgtgaaaaacagctgggatcccgaaacaatcaaacggcaagcagttagcagatgtaaggaaatacaggaaattaatgaggaattcatccggattttagaacacattgactccctgaaaaatcaggtgcttaaagaacaactgctgaaaaaagaatatgaactgttaagtctgcgtaatcaggtatctccccatttcctgattaactgtttaagtgtgatttcttccatggttggaacctctgtcagccctacccttctgaaatcaatggtatccacactggctggtcatctccgttacactctatccagcaaacctttcgtcagcctggctgaagaaatgcactttgtacgcaattattatgacctgaattcctttcgctatccagacagtctgacctatcagattgatatcaaagatctatgtgacaatgcggcagtctttccctgtctgattttgatgttaagcgaaaattccatcaaacataatttgagtacggacgaaaagctgaatcttattgtctcagcccaggaagaaaaagatgaaaatggaaggacttatgttcatatcagacatctggattcgggaaatggttttcccgatcagatgttgaaggatttgaaccgtccaaatccttctattcaggaaatagccgagggaaccaggatcggactttacaacataaaaaggcgactcctcctttcctatgatttacagggaaaaatccatttttccaacaattcggaaacaggaggcgcacaggtcgatatcatcattccctatgtttcctatccagatacctaaataaaagcataaggagaaatacgaaatgaaaattctaattatagatgatgaattctatattgttgaggatattcgcctgaacacagactgggaaaaactgggtatcagcgaacaatacacagcacacagcgtacaggaagccaaaaatgtaatactcctgcatcctgacatggatattgttcttactgatatagaaatgccaaagggaaacggctttgattttgtccgctggctgcatgaaaagaatctgaatccggtgattctcctgctcaccggtcacgaacgatttgactatgcccattccgcaattgaactgcatctacaggaataccttaccaaaccggtagatatcgcctctatggaaatcgccctggcaaaggctgttaaagaaagcaaacggagaaaagtttatccggaattattcaagcttgaccgggaagaagaaagtaccgaaacaaccatcgagcttatccaggcctgtattcggaagaatctctcttctcccgacctcaaccgtcagttgattgcccaattcgtccatatgaacccggactatatttccgccatcttcagcaaaaagtccggcgaatccctgaccagcttcattttgaaagaacgtttgaaagcagcgaaggtaatgttggctaccacggattattccatacaggaaatcagctatcgaacaggtttttccaccccttcctattttcaaaggcagttcaaaaaaaatgaagggattacacccaaaaaatatcgtatggatgaaaagatgaattgaataagtgcgctccactaaataaccacattgcttctacttcaataataggtttttatttaagcttattccctcgttcaaaaataagtgcagcgggaaaagcatactctatatgctttccctactgcacttatttttccacgaaacttcacttttttattgtctattacaaagtaacttgtaatagtcttctttcaggatagcataatgcaatctgtcatgcatctctccgttaagatacttaacttttcgttcaataccttccaggcataacccatttttttcaagcattctctgtgcccctgtgttaatatccaaagtattcgcatatatgcgctccatgcccaggtaagtaaaaccataatcaagcatcagccttactgcctctcctccatatcccttagaacggttaactatcttggcgattcctatgccaatagaacaatttctgttaattcggtcaatatcctgaagtgcgatatctccaatcacaatatcgttagcaagaaaaatcccgagtcttacatttgtatttccctgtagattttgaatctcatcaaaccatttctctgccttttcatcggaatgccctatattaaactcttccgtcggatttttaaaatcatactcatagtcattccatagggttttacaatcttttcgctcaagcattttgagatagatattatctccttgtattctcataaggcctctcctattccaagctgttcctccaggaacactacctgtcctgtttcttcatcatatccttcgtaataacctctccctgagactttccggcaagggttcccttcaacaccttcagaatccatgtgccgcatgatcacggggaatccatttcgctcattatttacccacggatttttttactgcccatagaatggctctgccggttgtctcacctattggatttccagcatagtctccatactctttttctatggcaaagccagcagaatccagccagtcatgcagctgttccaactgtatataatgcttcttagaaggaatcttcctttctaatcttcttccgtccttcagcgtcaagccaaaattacggacaaaagaaagcattcccgtaggttcctcaaagctttgttccgtcaggaacattctccctgaattgccttctctgtcggttccctcccagattaccatttcaccggatgaccggaacaatagcccgggatgcattgaaaactgatagtcgatataaatatggcctcccggagccagcgctcctgcagccctccgaatcatctgctgctgcacctgagcatagtctgtctccgacattatattaaacagaatatttcctgcaagaactacaacatcaaatccgctcccccaagcatcttctactgcatcagccttataccagacaatattatcaagtccttctgcctttgcccctattttttcaagaaggcaatcgtcaatatcaaaacctgttacagcatgtcctgcctgcgccaacggtacaaggatacgcccgcctccacaggctgcctccaatactctcacaggctttgaaccaatcacagacagcagaaagtccacgtcatctgtctctgtctcatatttttcatacatttccgcattccatgctgcaattattttttcttcattacacacaattgcatcctccgaatacaaacagaaggctccggaaataaccgccttccgcgccctaatttccctgtaccataatttcctccagccttcggccgcaggaaacccgaaactcctgaaaattcttctccaaataaagccgcagctcctgtgcggtcctgtcagtctgtgcaaactggcattccgtaatcacaccctgctccagcgccgcctcaagttcatccctgtcctcctccttaacttcaccctccggcgataccagtaaatccaggaataaatcactgacgaaaaacatcccgtcttcatcaacacctataccgtcaatgatatcaatataccaaaacaccggcctgtattcctgattcatatatacagttacagcatattttccgttttccggaacaataatgagccatttcataccgtcgtcacatacggtcagactttccttcccccagctccagacctgcttttccttcaccctttcgatatcaatcagagccagaaagcctgaaaaatccgggttctttatccttttctgacggtagctctttctctctatgcatttccattcatcatagattaatctgacatgctttatttccagcttcttcatggcatttctcttttcccgtaaaaatacaatccccttccggcatatacccaaatggcggcgtcattccgccgcctgtattctcttcacatacaattccatatattctttcatcctgcaaaactgctctctcgtcacagggttctcggattcgaaagccatcagcttcgaaagatatccctgctccagcacaatccgcaggctctcagggaaaaccagctcatacaccagtgaaatatgaccggccagatgatccgccgccgtccttttcagggtacgcagtatggcatgctcttcaaaaaaagctgtcatcacagcttcagaaaccgtacagtttttcagctccctggtggaaacattatagatttcctccgggggaaaatccacattcaccttcagaatatcgattttatccgcatcccgcaggatatggcaaaacctctgcgtcctttcatccagcccctccgggatacggtaagcgttgtggacaccgaccacggtacgaaggagcccatcctcgcaggaatcctccgtataatccctgattttcccatcatcaaaaagaatctgcgccccatacatcgcatggtcaatggattcagcatctataaaggttccgtaatttctcagctgctcaaacctccccacgtcatgcagcagcccggtaaaccaggccaaatcccgctcgtcttctgccatgcccagcgaagccgctattttttcacataacaccgccacgcggaaggtatgttctatcttcagcctgaccttatcatcctgcgcattataggcgctcacataatcccgaaagactttttccgctttaattctgtcaattttcataataatcgatcctttccctcacctttagaaacaggagattgctgaccttctacgtaacccggatttcatcagcattgattttcagattgtagcccattattgcatcactgtcaaatcttgcggcaatcttcttgtgcaatctcctccaggctcagtactacagcaacatgcagggaggttgttcatttattataaatcctctgtttgccagtatttccgccagattagagggtcttgtcatcggagtaatcagtatggaatcgggaagaatacctgcctacatcaaagatatcatcttcggtatttcaagctcctgattttctttcatatccaccgaataaatccgctcaaagccgctgtctccttctgccttcagataactgacaggccccgttataagtctctccccacgcattcttccccaggtggtccaggatatttctatcccctttacgatcatttccgcttcaaattctgccgccccgcccgcatcattctgcagatgatttttttcttccattgtgtaatacctcccctttttcattcagtataacaaacaggcgtgacaacagtatgtcaggttttaatatttttaaggttcctcaggagtcatgaacgaatacgcccgataggtacaatccaaccggtatcccattttttccgccaggctgcgtgatgccggattctgtgcatcccagtgtacgtcaaaccctctcgccttacagtccagaagcattgcagaggcacaggcaattcccaccccctttctcctatgctcttttgcagttacaatatccagctccagctggtttttccaggaaagaaaagaggaggcggacgaaacaatctggccctgataccaaactaccgcaccggatgcattcctttgaaaatcttcataggatgaataggtgcttgcatgcataaaggggtttttgttcaaatacagtccggtcaaacatggtcaatttgtattcatgtggcagcatttctatgtatctgcaaagcactttttcatccgtactgcccggttcatatttcatctgataccgcgttacatgcaccatttccgggtaagatgtcagtagtgcttcctcccattggcgcgtcatgcagataaacatccggttgttccatctgttcttcaactcagaaaggataccctcctctgcttctcccagcagatagataaatccagcttcacaaacacagctcctcccatattcaaatatagttccgaactttccgtccaggcaggcctggagcagcaagggctgatttacaagcacagtatgtacctctgttttcttttccatatttaaaaatggcggcctatgtgagaaattacacatctactgttatcctgcatctaaatctctgctaatgcccccgcaaatcccacgttacaaacggctctcccccatctccccaggaataaacaatataaaaatttccaggcacatcttcatactggctgaaccttaattcatcgtaataatctaaaaaatcaagccccggctccttttggctcaccacattgcattcccattccgtcctgcgatattgtgagtaaaaagtttccagctcatcaagcgtcagttcactccgaagcaggatggctccaaaatactgcatgccgttcccattcccggttaatttgtccgctctggaaacagaagcagcaagctccgtatccggcggcagcggcaggcttttcaagtggttctccactccctttgccgtcaggttatttaccacgggaatggaaatggtgaacaggcaaatcattgtaaacatacaatagaaagctatttttaaaacttttcccaatttcttcatatagcattgcactttctccgccggtcccccttagttccgtcaggggcgccctgcacttccctccatccattcatgatcgaaatatacagctgattctgcaaggtgtcaatataaatgcggataaagcgattctcctcctctgtcaccgcttcgcaggcctcaaccgcattatccagaagatttgccagataaactatcagttcgtcatatttttccggaaagcacggccgcaggaccgttccggaaatttaatgacagtatagcatattcctttttctctgtccggtctgctgcacgaatggttttgaaggcgcacgaatggaaactgcaacaaaaaatctgccccctaaggctttacacctaaaagggcagataaaatacattcatactaatacttaattcaggtagtatctattgttctgaaattaccagcagcccacctgcagtcatgggaactgcccggcattctcccttcttttcttctacattttccagaacatgcccccgacaatcatatctgcagatatttctggcatttttttgcttcatcagcacataagcgactggtgatttatttgcccagataattgtatgcttcctgagatcttcatttaaggaaatcactctgtccgggccataaaccgcaataatctcttctcccctcaattcagtacgtacaacgggatatagatggccggcctccgtcggcataatctgtgactgctgcaaaagttccatattttctttacaaaactttatccagaatttaagtacttccttctgttcttcagacagccgatccaggcgcacagatatctgtggtgtggcaaaggctgcattctgcagctgtattgcaatatcttcaggcagttccctctcattccacattatcatatccgaatgaactgcagtactcccgctaagcatgcgcaaatccacacttcctatccgattggtcaatgccgattccggacaatcagccactctgaagatatttccatatctgcggattccgggtccaatgtatcgctgtctgaattcaatcataatatccgggttgtactttttcagttccgccgttacttcctgtaataaactgtccagagcttcctgaatactcctgcagctgattccggttctctcaatacagccgctacggaaaaaaaactcgtcaataaaatccagctttaacccatctactttccattcctttaccgccctgacataaaactggagcagatattgtctaatctccgggaaacggatatccaatacccccgcctgacgggacttatcaaaataaataagtttatcggaaaattcttcccaacgttttgcatggataccgataaaaggaacactgaaccaaatcataaatttcatgtcaagctggtgaatccgttccacatgctccttcatagaagggaatttttccagcgcaggttcccagtcgccgcagtaagcatacccgcggttattgtcatccgtctgccatccatcatccacaattatggtggaaaaacccagttctttagccctttgcgcctcttcttccaaactcctgtcagctatctcctggtgaaaagaataccacgtagaatacatgggataccgcgcggtatccggtactcccagaggaaccagccccatcgtcttttcccaccagaaacgtacatcatccactgccttccacacaggactcttttcctgattcagatacaaagcgatactatagctatccacctcttccagctccccggcatcaatgcatgctgaaaataatatggtaccatcttcttcatgcaccccggcattcatatgtattgttttttgtgtttcggaaagtgcaagcgtaaaccgattttcatcgcttccgtttatcatagagattaccggagcggacacagcattcatagtatgcagatcctcatcccaatccgctcttaacgttcgatcacaaccacaaacgggatgccagcggtacataatatcccgatcaggaatttgaaagataaattcaattccctttcctattacattccggcaatggccggtaaagtaaacatggtacacccacttgtccttaacagtatattcccaatgctcctccatattcagatatgccggatgcgctgtcctgatttcatatggaaaatttctgctattctgtatcattttccattacctcaccacccggatgcagctttcctgcgtgggctctgctttagcgtatacaatgcagacaggcgcacctgcttcatcagtttcattttcaaaagatatcggcttttcatccagcaatgcctcccggcagtttccggaaaatactgcttcccactctaatgttttattggtttcattcttcagaaccgttttgcactttccctcgtgtgatacatctattgttccgtcaaaaatcgggagcttccgcatcctggctctttcaccctccgggattccgctcttagttataaccattccctcttttgtttttattcccatcacacacccggctactgaacctacataggcgaatgaaacctccgggtattctctcctttccaactgtggatttcccgtctcaatcagaaggtcaagccctcctgcctcatctccgcaagtataaaaaatctgcggcatataggacattccttccacattttccggcggattctttcggatctgggcataagcttttttcagggcttcttctttattcagaatgccataataaacgggaagaaaatttccttccttataatattccttataaaagctgccgtctgccagaattgctccgtaaaatccgtcttttcccttgtcaaaccattccgtcagatacttctgttttaataatttctgcctgtcctgataaatagatgcctgttcttttttcccttgccttagaaggatttcaccataagcgccgtatgccgcccactggcaggccagcatatcaccggcagtcaatattgccgtatcacattcattataagaggccagccctcttctcccatattcaggataatgctctaaaaggccatcaccgtccttatcccattgctccacgaacctggtacacgtcagttcataaaaacggttgaaaacaggatcggttatataatccgtatcccctgttctcaaatattcctgccaacaggcaatgattatttcaaaactgccggggaaattataccagaaatcactgtcactgatgtaatcctccgggcatggcagaccatccttggttatttcccaataaccacaccagtcccgttcctcactgatactctttgcaaattgatacagcatgtttttcgtatgcgccgccagtccaagcgccgcggctcccgacgcatggtgtgccgtatccctcatacaaaatgcatttcttgacggcagggcggcctcataccagagccccacagcatcttcgccattatgtacataagaaagcgcctgctgcctggcccatttgaatccttcatccaattttaatagagagctggaaaattccagtgtcccatatccgcaatctgtcataactttcgcaattctcctttactcttttccgccggagaaggtaacaccttccacaaatgccttctgcgcacagaagaataatattacacaggggagtattacaatcagagaagccgccattaataggttggtatctgttgaatatgttccctgaaatcctgctaatcccaaaggaagcgttttccacttatcactgttaatataaatgagcggatcattaaagctgttccaggaacccataaattccataattcccacagaggtacagatgggaagcgaaagggggataaaaatcttcgtccagattccgaaataactgcacccatccagcctggccgcttcttcaagactggccggaagcctggaataaaactgccggaataaaaagatatagaacgcacttccaaaaagtttggttataaacagcggatataaggtgtccagcatcccaaaatttttaaacatgataaacttgggaatctgcataacctcaccgggcagaagcatagttgccaataccagcataaacaggatgttgcttcccttcactttaaatcttgcaaaagcgtatccaatcatggaatttgcaaatacggttgcaataatggaaatgacagatactatcatggaattcttaaaataggtaaaaaaagaaaaggaggtcagcgccttctgataatatttcagggaaggcttctccggaatcaggttcattcccttaaccgctatttcttccaaacttctgaaggaagaagctgccatccaaagcagtggatagagaaaaataagggaacctatgatcaaaactaccagcactgcaattgtttttatcttcctgtttttcttctgtgacatattatttccctacctttctctttttcttcccggcaggcatcatttcattttcatagtaaacccacatatcgctgcttctgaatacaataagtgtaaataccatgatgattaggaacaatacccaggcaagcgcacatccataccccatcttaaaccattgaaatgcattttcataaagatagtacgcaaagaacagcacggagtccttaatacctccatccaccatgtacccctgcgtaaatgtctggaaagcgccgatcattgccgtaatcatgttgaaaaaaataataggcgtcatctgcggaattgttatggaaataaatttccgaaaaccgtttgccccgtctatggaagcctgttcatacaggcttactgaaatatcctggaaaccggcaaggtagataaccatgctgcctcccaccgtccacagactcataatgattacggcaggcagcgaccaggcaggatccgaaaaccaccccggcccctgaatcccaataagctttaataccgaattaatcaagccgaaattagggttaaacacccacatgaataagaccatctggggaactccggaaatcaggttcggcagataaaaaatagtccggaacacgttaatgcctttgattttattattaagcagcgccgccaacaaaaatgccagcactacctgaaggggaaccgcaacaaaggtataagtgaatgtaacctttaacgactgtgcaacatgcttatcacttaatagctttgcatagttgttcactccgctgaatacaggggctgtcacgagctcccaatcaaagaagctcatgacaaaggagtatatcatcggtcccagtgtaaacattaaaaaaccaaagagccatggtcctacaaaaagataaaagcttttggttgctgaatctatcttttttttcaaatatagtatctgcaggacagcatacaatattgcaaaaaacagaattaccacactgaaaaaagtaaataaggatgctcccgtctgggacaggcctgttgctttaaacaaactgtttattttcgatatccaacccatttatatgcctccgttttatgccccctgccgcttactgctggagaatctcgttgatctccgctgcaatgtccggaaatacgtcttcaggcttctcagtaccggtaccaactcctgtttcgtcatccacacggcccattaccgaactaatttcatttgttcttttctgtgtttcctggggagtctgattatatgccgcatatacatatgcattcatatttttttcaggataaatactttcaaatgccggtaatgcatctacgttaacaggtactccatatgcgctggaatcaccgcctattgccttctgtgcagattcgttttcacacatatactcaacaaatacctgtgcagctgccttattttctgaagcgcctgcaatcgcaagtccgtctacctctttacatccgccattattgaaataaggaagcagatcccaatcaaagcttacttcttccatttgcggaatgtaccatgggccaaaatcagtatatattgcaatcctgccgcttaaaaaccaatccatcatactctgtccctgcgcctgaatgctgtcagggacatatcctgcagccctggaatctatcacaaaattagctgccgcaatatcttccttggaatccagattgctttcagtgccgttgttcttatagtaggaaccgccgaatgcataaatcaggttacccatccatggagactcacagccaaaacgctgcggatccgtttcctggctgctcagggccacgattgcctctttaaatgcatcaatggtcatgggagtatctttcgcaggaatttccacaccgcattccttaaacagatctttattgattgccataactttgggctttacaataaatggcctcgctttcagttctccatcaattttaagcgcttccacaacattttcagataaatacttagttacatcaaccgtctgtgtttcaaaattcgctgcaaatcccggaagatctcctgctgaaatcaaataaacatccgctgtggtttctcccgcaatctgtgtctgcagctttgtcagataatcagcttcaatccactgtgtttccacttcgatttcaggatgtgctgtacggaaatcgtttactgcagcctgaatagcgttattttcgctctccgcgccccaataagcaaatataattttcccttctgataaatttccgtccgtacttccggattctttatttaccgcttctgtactttccgcagcggcttttgtatctgccgtagtgcttccttcctgcggagtgctgccgcagccgcccaaagtagctgcaagcattgataaagttaataaagcagccaataatttctttttcatatatgtattcctttctgcctcttactcatttttattttatcattttttcgcatatacatttacattacatctttacattcattacaataacggatataatgaatatgtcattttttgcaaacatgttatcagtccccactgttcctgtttcagaaaatgacgtttctttttattactgaaatctttttattgctgattctgtttccttctgttatccttccggcagctctctctcacaatcagtgtcgcgggcaagaccacctttaccggtaccttccggccctccagccgttgctgcagacaatccacagcacattttcccatctgaaatgcatgaatcattaccgttgtaagaggcggtgacagatactccgtgtcctcaatattatcgatgctgatcagcctgatatcctttccaatgcgaatacctgcctctgtaaaagcccggtatactccaatcgccatcggatccgcacctattacaaaagcatccggcagttgtccggactggacagcctttcgtgccagttcgtatccaacagctttcgtgaacttatctcctatgtataaatattgcttgtagttcaattccctcgcatttgcataattttcaaaagcctcctgcctgctgtcaatcttacggataaaccgttcattggaaaagtcatttacgtaatcccagctgccaatataaccgattttcctgatatcgcattccatcatataatccattgcaatgttgattgcatccgtaaaatcactgacaacacagtcatatttatggtaatcatagttgtaatcaacaaaaatcacatttttcagctgctggaaaaaaatattgtcttcatgaaaggcctttttaccgattacaatgatactgtccaccttctccagcctctgataatcatcaggtccattgacaggaagcagcgatacattatggaacccaagctcatttaaccgttcctccacgccatttctgatataaaggtaataaggatcttggagctctccccgtccggaagattccaacccaatagggattattccaaccctatgctcttttatatttcttgcatgcaccacttttcctctgcctttatactcatatttaagctcctttgcacaaagtaaaattttctggcgagcctcactggacgcgttaaaagtaggatcgttactcaatacccttgaaatagttgcttttgaataaccagttttctccgcaatgtctctcaccgttgccattttttcacctcccttcctccacaaatattttactaaatgttttctatgcaataattatacaacttcacttatctttatacaatatagcagttttttttcgccattttatccagtttttactacagtactcttgtgttatctcaataaaaaaccattttaaatctcatcattttactattaatttagtaaacaaaaaaataagccgtattatttgtcatcatttgacaaaccatacagcctcttctcatccttactttttttctgttatattaaatgtccgattactaagaaaatacatgaagaataacgtagggaatgaatctatttaacgctatgtctgcacggatgtcaaaaggcacctggtaaaaaacaactttaccaagtgccctctcattcagccggataccggattgttcccgtctccatctgagttattcctgtaacaatacagatcatccaatgggccggaaggcaaagaattccggattcccgtcctcatttctgtaaagcagctcttccacacaggctccctttttttcatcaaccagataatccttccaaccgttttcctcctgacccagccagcagatactgtagcgtttttccacgggatcaagaattactgttttaatcgtaccaaaaccatccttatagtaatgcgcagtcattccctccggatattctgcaagcataaatttacggatttcttcctccgaataccgttccttttcttctgcaaacttcttcaatctgtcataccttacaattgaattattcataccggccggttccagatgcttaagctgctctattacgatatgattggtgccgcacagatactggggaccttcattcggactgatttgctcatatgctttttctccgtccatggtttcgaataaaatccctgtgccggaaggatctgccaggtaaaggttgatattataggcaatgggcatttgcattaccttttccaaagcctcctgtgcatcagcgcagttttcaagcaggctgcggataaccgcccagaactgcagcccttttatcttcggcgcacgcatgccgggcatgttgctgaccgggaagccgcaggaggacatggataccgccagccctttttcattgattccctcgcatctgccgaactccacgatcgtacctgcgatatgagcgtattttcccgcgggcgcggtcctgcaaagcttcagatcctcatcctcaatggtgaattcataattacgggcgatttttggatgcccgtccagtgttttctttccggtaagtatcaggccggagcagcggggcaccagcatggtcatccaggtataggcaatgtcctttaccggaatgccggccgcttctgaaaatccctccagctcctcccggatgccgggacagtacatatcgtaaagcccaagcgcttcctccagcgcctccctggtaaaatattcaggggcaggaatataccattttcccgtatcctcctgtcctgctatctgtcttcctatttcccggtacgtcccttccagttcataatagcttactttctgtttttccatagaatgcttcatcctttcttcctgtctgcgttttcgtctggcaacagctcagatatcctggctgttacggtggatgaatctattctattctctgtttgcttattaatcctgtctttttctgccgggaaatgtcctgcaggctgtctggaaacaaagattttctatgctggctgccgtccacactccgctgcgccacagccccttgcgctcctcttcgccgtttcagcccccgttgcccccgtcagactgcaaactggctgttatacaatccggcatagaagccgttcttttcaagcagttcttcatggcggccctgttccactattttcccatctctcatcaccaggattacatccgcctccctgattgtggaaagccggtgcgccacaataaagctcgtcctgccctccatcaggcgggcaaaggcttcctggattttcatttccgtcctcgtatcaatggaagaggttgcttcatccagaatgagcatgggcggcaggcacagcataaccctggtaatgcacaaaagctgcttctgtccctgggaaaggcttcccccatcctctgaaatcactgtgtcatagccttccggcagacgtttgataaagctgtgggcatgggaggccctggccgccgctatgatttcctcctccgtggcatcgggctttcccatggtaatattttcccggatagttcccgccttcagccaggtatcctgcagcaccataccgtaaccggcgcgcaggctcttgcgtgtcatatcccggatatccgttccctccacccggatttggccgctgtccacatcataaaaacgcatcagcaggttgatcatggtcgtcttgccacagcccgtagggcctacaattgccactctctgtccaggctttacctgcagattgaagtcctcaatcagcttctgctccggcgtataggagaaggccacatgggacagctccacatttccccggatattattcaggtgcattgccccttctttttccggtgtctggggttcttcctctattaaatcaaaaatgcgtcccgcgcaggccagcgcgttctgcagctccgttaccacgccggatatttcattaaagggcttggtgtactggttggcatagctgagcaggcaggacaaatcgcccacgctgatccggcccgccaccgccgccagcgcgcccaccagcccgactcctgtataaaccacgttattgacaaagcgggtggcaggattggtgatggaggaataaaatatagccttcagggagcatttctgcagccgctcattgatttcatcaaactgctccatcgccttttcttcatggctgaaggcctgcaccaccttctggtttcccagcatttcatcaatcaaagcggtctgctcccctcttgtttccgactgaagccggaacatggtgaaggttttttttgcgataaaagccgccacaaacagggacaacggtgtgataagcactaccacaaaggtaattcccacattggttgcaagcatgaacaggatagtccccgcaatcgtcattacgccggtaaaaaactgggtaaagcccatgagcaagccgtccgcaaactgatccacatctgcaatgacccggctgacaatctcgccgtaggagtggctgtcaatgtattttagcggaaggatttctatcttgcggaaggcttcgttcctgatatccctgacgatgtgatatgtcattttattattgcagatattcatgatccactgagccagggcagtaacggcaatggctatggctatctgtttcaggacggccagaattgccgggaagtccacctgccccctggcaatgatatggtcaatggcccgcccggtaagcttgggcacataaagggtgagcgccacgctgacggcggccagtaccagggaaagccccaggtaaaaccagtaaggcttcagataccggagcaccttgacaagggttgccttctgctttgtcttatcttcttttgcttttgccatgagcttacgcctccttccttttttcaaactgggaataataaatttcctggtaagccggacagttttccagcagctcctcatgagtgcctatgcctgccacttccccatcatccattacaatgatctgatccgcataacggatggaggaagcccgctgggatacaataaatacagtgggtccgtcttccatttccttgatcgccttacggagcctggcatcggttgcgaagtccaacgcggaggcgctgtcgtccaggatcaggatttccggatttcttacaagggccctggcgatagtaaggcgctgcttctgcccgcccgacagttttttcccgccctgggccacaggagcatccagcccgccgtccttggtatccacaaactcccttgcctgggaaatatccagcgcgcgtaaaagctcttcctccgtagcgtcctcttttccccaccggaggttttcccggatggttcccttaaacagaaccgccttctgcagcaccattcccaccttccggcgcagttcctccaacgaataatccttcacgtttttaccgctcacaagtacctgtccctttgtggcatcataaaaacggggaatcaggttcaccagggaagattttccggaaccggttcctccgatgattccaatggtttctcccctataggccttaaaactaacatccgtcagagactccgcccctgcatttttataggtcaggcagacatgatcgaactccacggaagggagcctgtccaaagcctttttcccaacggcgccagtgtcctggcctgatacactatctctgtgtccatcatcctggcagccgttcccgtccttcatactggattctatttcaaaaatactctggatacggtttccgcaggcgatagccttggtaattgtaataatcagatttgcaagcttaatcagctccaccagaatctgggacatataattgaccagcgcaaccaccgcgccctgcgtaattatgccattttccacacgccacgcgccggtccagaccagaacaatgatcgcgccgttaataatcacataggttacgggattcatcaatgcggagattttacccacatgcttctgcatggaggtcagcgtattattgcttgtttcaaacctgtcgatttcgttctcttccttattaaaagcccgaagcacacggacaccggtcaggttttccctggtaatccccagcaccctgtccagcccaccctgcacctttttataaagaggcatggtcagcatcatgattccgaataccacaacggaaagcagcggaatggtcaccacaaatacaagagccgccttcacatcaatggtaaaggccataaccatagcgccgaatacgataaacggggaacgcaggaacagacgcagcaccatgttcaccccgttctgcacctgattggagtcactggtcattctcgtgatcagcgtggacgtccccaccgtatccatttccgtaaacgacaggctctggatatgggcaaacagcgcatgcttcatctttgccgcaaacccgaccgccgccttcgccgcaaaatactgggccgtaatggaacataccagccccacgacaccaagcatgatcatgacaaaacacattctgccaatataccctctgtcggcattcccaatccccttatcaataatcgccgccataacaagcggcaccaacagctcaaaggaagcctccagcagcttaaacaacggcgccagaaccgtctccttcttataatccttcaagaaaacaagtaacttcttcacaccctcactccttcagtatattttaaaaatcccaaataactgttcaatccaccttcacagcaattgccctgatctgctggtaacagttcagccttaggccgacctgttactgcatccgcccatgataagtcgccttcggcgaggggcggatgcctgctggcatcacgttttctcacggtttgcgcagtaaatgtgcaaacctgcctgaactgttacatttgctgtttcacctgccaaacagttacttgccaaatttcctcgtctatcgtatcataaaatcaggtatattaaaattattatatttatatataatccatacttttaacatatatattactcaaattctgctccgggttttacggtaaccctccggtatcaaccgaggcatcccgggtctggtgttccggacactttggcttcctgtcccccagcccggctttcctgcggcggcgtatgcttttcgcgggacggaggtgttttttgcgggtgtattttataccatggagaggagaccgaaaaaatggaaggtatcctgacattttttgccccgggctcatcggaatgcccggtataacccgcaccaacaaaaaaagcgcctccgccccgcggaaagcatacgccgccgtaggaaagacgggctggagggacaggaagccaaagcgccgggacaccagacccgggatgcctcggttgcttcacgctcaaaaacaatcacaggagaggtagattcatggaattaaaacagctttcacattttgtaaccgtggtaaaggaaggtaccatctccggtgccgccaggaaactgaatctgtcgcagccgccgctgagtacccagatgaaacagctggaggacgagttcggctgcgtcctttttgaacgcggttcccgaaaaatacaactgacggaggccgggcagctgctctatgaaagagccgtaaccatgctggagctttcggaagcaacccgcagggagctgctggactataacagcggtctgaccggggcgctgcgtctgggtgtggtttcctccgtgggaagcagcctgctgccgctctgggccgccgcgttccatcaggcctaccccgacatacgctttgaactgtttgaggcaaatacctatcagctcctggaacagctgcgctccaacttgctggaactggccattgtgcgtactccttttcatgctgaaggctttgtttgcacttccctgtgcgaggaaccgatgctggcggtgggaagtgaaacctttttcccggaaaaaactgtggtgccttctgattccggctgttttgacggctgcattaccctggaggccctgagccgcctgcctctgatcgtataccgcagatgggaaacgcccctgcatgacgcttttacccgggaaggactttccccctcctatttctgcctcaatgacgatgccaggacctccgtccgctgggcggacgccggcctgggcgtgggaatcgtacctgcttcctcgcagccgctgcttcaaaatccacatacaaaagtatacaaaataagcgacagcagactctttaccagcatttccgttatccataacaaaaatgcgtatctgtccactatcgcccgtatgttcttaaaacatttaatcaccgaaatgcactgacctgccgcaaggatcgcagtccggataacagaactgtcagtcaaataccccgccgaaagcaacagagtaaaaacaatatcaccattttatcttttacagaaaatccttcaattcacgcaaatgtctgatttcccggtcaatccgtagccccggggtattctgctttcctgccggattgaaccagcaggtggcaatcccggcattgttgccgccctggatatccgacgtcagggaatccccgataatcatggttttttccctttggaaatccgggattctctgaaagcagtagtcaaaaaattccgtctggggcttctggtagcccaccgcctccgacacaaaaatatccttcataaaacggtccagcccggacagcttcagccggttgcgctgggtggcctccacaccgttggtgaccacgtaaaggtcatatcttggaaacagccagtccagaacctccagcgccccctcaatgagttcatgcccctctcccagcatcatctgatactcttcttcaaaaacagcaccgtctccatcgatcccaagctgttcaaacagcctgccgaacctggtaaaaagcagcgtcggcttatctatctcgccccgttcaaaggcctcccacagactatgattgatccgggaataaatccggtagctttcctcgtcacacggataaccatgagcctccatagcgcggtaaaaggcagaatgctccgctgctgagaaatcaagaaaggtcccgtccatatccaaaagcaaggtagtatattccatgtttcttcctctctgttaaaaaaataatatatcttaataattcttacagtctgcatagttaatatgcagactgtaagaatatgcggcggcagcaaacatctgctccatcatagagcgcatttagctgcccctgtttatataagcattggattattggttaagtaacatcttagctatgtccagatcgcttttggaagaatcctccgttattaaatcgactgccttttgtacataagcatcttccagctccaatgcttctgaaattgcagtagcattaagcccctttttcagttttcttcttatcatagatactaattttgcttccccttcggcacggcctatttttaacccatcctgcaatccatcctgtcttcctttttcaataccaatctcaagaatattcatctttacagcctcccattcttccgattgcttcacttcatttacgattttatccaacgtaataatccgtttatcctttatcttgacctcaggattatcaatcgtggtatttttcatatactgtagcaggcttatcagctcaggacggccatttttactggtcatgttcagaaatattttcttcgtgccgtcatccaggggaagctctgaaaactcttcacattgttctgtaaaggtatagcttgcccggtcccgtccgaaaatgtcttcctgcgtgataaaaataatgacagttgacggcaggtgcttataccgggtcgtctttcctgcctttaaaaccggggtatcaagcaggccctgataaaatctcgctctccgcctcacatcgtccgcttccgtatcattctgcatctccgtattaaaacggcggtcagatacatcccgtgcccaggcatccaaccggatagcccgttttccgctcttgttgagcactacctgctccacctctacctccgccagcttcaaatccggctcatccagaataatgctcagcgtactttcataagcggttttatttccgcgagcaacgagccaagtagccatgcttgcatggctatttggcgactgccgcgagagtcaaataccccgttgcttgcagcggggtatttgactcttcatgacagataagaataaagcaaaatcactcagattaaactgatagttttgggacagcgcctgcatggcagccgttccggttgtcttagaattcataggcattcctctctttcttttttggcagagagaaccatgccttctgcggctgcacagatttctggcagccgctttgtcctccctgcttattcttttgtcagcaaggagttcatgcattacagtacatatgtaaaaatgaaaacctccgtcaggcagaagtctgtacatatgccgtccatgcacacgcgaagctgcgtgcagataccggtctgtgggctgaattgccttcacagagcggcgcagaatcttaaaagataaaaagatttgttgaagtcattgcttatcccgattgtagcatacagatatagtttctgcaataattcctgatagtatttatttgtataaccgtaacagttcaggcataaaaaatcaggcatcccgccgccgacaatctctgtccggttggatgcctgtctttttcacttattcatatgttctgcgcaatcaaatcccccgcggcaacaggatatcaaacttgcagggctgctaagcagcggggtatttgaccctcgcggcagtcgccaaatatccatgcaagcatggttacttggctcattgcccgcaggagtaaacgcaaatcactgccaaagctggcgcatcagtccaccgtaacccggaacaccaccggcttgtcggtattgacgccgttcaccttcacatgcagcccttcctcatctctggaccagctgcactccgaatcaaagccgagaatttcaacgttacggatgattccatggaagttgggcttcttggaggcatcctgttcacccagcgcggggaacagatagctgccctccggcgaacatttcagggctgtggcatagatatgatcccccttcgcagtatagcgcacatccgcaggggtaaaatcctttttgattccgtcggagaactgtccttccacaatctgcgtagggccttctccgtattttctccacactcctgtgtcataaatggactccccgttatctctcagccagtcgccgatttctgtcagaatccgggtgtcctcctccgaaatggttccgtccgccttcgggccgatattcagaagcaaattgccgttcttgctcacgatatctaccagatcacagatgatatccttcgcaggcctgaagtcattattttccgtatagcaccaggaattcagagcaaccgcagtatcggtctgccagtggtacggcttcacatccgcaaactgcccgcgttcaatgtccaccaccgccgtgccgaacatgaaagcatcatgcttgtagttgatgaggacctgctcaccccactcctctgcacggttataataataagcggccagctttttcaggtaaggcttaaaggcgctgtgctgtatccaccagtcaaaatacagaagcttcggctggtatttatcaatgatttcacaggttcttaccagccagtcctgaagatattcctccgtaggctccggtttcccgtacagatcctgatgatccggctccgccatggacggccagtacagatcccctcttttcagaggctccttaatgtcactgtcgaattcctttccatgccccaggaaaaaccagtgctccgcccggtgggaggaggcgcctcctataagccctctttttgcaaaggcttccgtcagttctcccagcgtatccctcttgggtcccatttccccggcattccagtgggaaatttcactcttgtacatctggaagccgtcatgatgctccgctacgggcaccacgtatctggctcccgccttttcaaacagatcagcccattcctccgggttgaatttttccgccttaaacatagggataaaatccttatagccgaattccttatgcggcccgtaggttttcacatgatgctcaaattccggcgttccctgaatatacatgttccggggataccactcattggcaaaggccggaacgctgtaaacgccccaatggataaaaataccgaattttgccttcacgaaccagtcaggcatgggatggttccccaggctctcccatgtatccttatagggtccctgcgcgattactttttctattttttccagatattccttcagctccgccatcagtccgtcaccacacccttctggagcatgacattggcatacagcgccgtctctcctgtcgctatgattgcatacgctttttttgcttcctcgtaaaaagcaaaccgttctatgtggccgatagcctctctgccgcggctttcatatttttcctcgatctgcgcataggcttcccagatgggcgtctccaccttatccccgggcattacctccatgagggaaaagggcttttccacatagctgtccagcggaaatacctgcagtatggcatccagtatttcagggacgccgtgtccgtccatgcggattaccttcgcatttttgcccatggattctgcggggaagttgccgtctgctatgacaatgcggtcgctgtggcccatttcgcacagaaccttcagaagctcgggagataaaattttcggaattccttttaacatgtgattgtcccctccatatcccacaggtcttcccagccctttgccccggcccacaggaatacctgtcctttgatcagtctgcagtttttatccgccctgcggatgctctccatctcttcttcggtaagcggatcctcagttacgcaggcaaggttgcttacatactggggttccttcacggaaaaaggaatggggatctggcctctctgcgcagcccatttgaggcacacaagggcaggatggatgttgtgtctttcagcgatttccacgatttccggcatctgggtatcagcgatgtcctctgcggttctgtcccgttccggacgggaaggggaaccgatgggacagtaaccgataggctgaatgccgtgggctacggcataatcaaacagctccggctgctgaaatccgggatgcagttccatttccagggccgccggctggattctgcacagcggcagcactgcctccagcttgggaacggtcatgttagacatgcctatatagcgtacctttccttcatccaccagctgttcgcactgtctccaggtgctcatgaattcttccacactaaagggcctggaatcgggattccgggaatctccgtcacagccgggcgcatgatagttggggaagggccagtggacaaaataaagatcaatacaggaaagctgcagatcctgcaggcttttacggcaggattccagtaccttgccttcaccatgcatgtcgttccataccttggaggttacgaacagatcctttctttccacgatgccttcctgcataacgcgttttaacacttctccgattctgtcttcgttctgatataccgctgcgcagtcaatcaggcggtagcccgcctttattcctccgtaaacggcttccgccacctgttccgggccgtatttgtcggaaccgaaggtgccaagccctaccgccggaatggtctcgcctgtgtacagggcgcggcgggggattttattctgatctatgattgctgtcatattctctcctttttgccggcaggaatttactatggaaattcacggctgccgtttcacacagcagccgcttttaccgccggctttcaccggttactgtttagtcaaaaacaactgctaccttgccgcagtttccgcctgccataagtgcataggcctctcctgctttttccagcgggaactcatcggtaatcagatcctccggatggatgccccagcgtacaagacgctccaccagttcctccattctccacagcgaggttacccaggagccgtaaatagtcttctgtccatggatgatgtcagggctgggattaaaggtgcaggtgccgccttcgccgacgaatgcgattttgccccattcccttgtggcgcggatggcaagctggcgtcccggatcgctggcgctggcgtcaatggcgcgctccacgccgtttccgttcgtcaccttcataatgccgtccatggcttcgtccggtttgaacacataatccaccagtcccagtttctttgccaggccgatacggtaatcattcatttccacgccgatgagcatattggctcccatggcctttgcaagcataagcgcagccagacccaccgggcccaggccggttaccagcaccgcatcgttgccgcagatgccgattttttcaatggcttcatataccgtgccgaagccgcaggctacctgtgcgccgtccttgtaggtcagttcgtcaggcagcgcgatcagatccttttcatccgccaggatgtagggcgccatgccaccgttcctctgccagccgtaagcctgacggaaacggctcttgcaggatatgtaatagcctctgcggcagtcattgcatacaccgcagccggaaatatggtaaacaataaccctgtcgccctttttaaagcgttttaagccctctccttcttccacgatgacgccgcagggctcatggcctgcaaccataccgggaatgtagccctccggaccttttcccacatgttccctgtagatacagcggatatcgcttccgcagatggtggtagccttggtctggatcagcacctggccgtgaccgggcttgggaatttcaaattccttcatttccactgagctgttgccgggcagtgtcgcccctctcattctcattttttccattgtttaacccctttcttttctaaaaaagcaaccgtcaggacagtgaatggccgctcttcttcagccttcagccgcttcacagcagcagtgaccgtatgtcacaaattgtgtgttaactgatatccttattataaaagctaatgggaaaaagtattagagaaggatttgacaacttgcttcattttatgtcgcatcagcgcaggtttcttgacttcccggccaggaaacgttacattaatatataaggcagaacgaaacaggtcaggcaggccccgcattactgcgttggccaaacgaatatacgtacggcagccgccggcccaatacacagagcttttaaacggttggatgatatttgaaaggaaacagaagatatgcgcacgaatttcagcgatctggatatccgcttcaccattggggatacgcggtttcaggcacttaatattatctatgaaagatttctccgcacggttcccagccacagccatggcagcgggagctatgaaatccactatattccccgcggctacggccgtgcacgcatcaatgggcgtttttatgatattgtgcccgggacgctttatgtgaccgggccgcatgtggagcacgcgcagacaccgcacctggaggatcccatgtgtgaatattgcatttatctgaaaacggaaaaaaagcgccgctcccagccctccgccgggccgcagccagacggcagggaacgggcgttgtccctgtttgaagggaccaccttctggttcggccaggatacccagaatgtggcttttctgatggaagagcttttttccgaactggaaaaccgctataccggttttcagctgcaggtggagctgctgctgcagcagcttctggtcaggctggtgcgcaattatgaagaaaaaaaagaaaccgggagggcttccggcttctctgcggcggctgataaaacctccgtgatcattgaagattattttctctatgaatatcagagcctgtccttagaggagctggccggaaagctggggcttggcacaaggcagacggaacggctcctgcagaagcattacggcaagacctttctgcagaaaaaaacggaggcgcgtatgtccgccgctgccatcctgctttccgacagcagccggagcatcacctccgtggctgaagccctgggttattcctccatggagcatttttcctccgcatttaagaattattaccagctcagtccaaggcaataccggaaggaaggggcttatcacagctttccggagccgtagccgcaatcaaattctaccacagctttcccgaaagcagcggcagcggttccagaaagcgttccagaattccctcctctgtgacacccgtatccaggcttcctatcgtatcgttccaaaggcagtaaaccgcccccgccatccgaccggaataggcaggcagcatttccgcctgtgtccccgcggcgaaaagatttggctcccactgcttcagggcttccagatccagacggtcgtagccgcctcccgggataatatacaggctgctgttgagggagttaatgatggtaaagccttccccatacatatcctgcggatcggcccattccatattccagatctgcatctgcacattttccgaagccacctgcgtcctgccgggcaggcggctcaggctgccccacatacgcacggtgcggccgctttcctgaatcatgcttatcatgtcattggcaaagctgcggtaatcctccccgtccgcaaaatattcatccatcccgatatggaccagcccgcctgcttcaaaaacgggatcctccccttccagatattccttccagagcttttgcaccaggtcaactgtcccttttttacccaaatcaagctgatccacattatccggctcgtccgccagggcatattccgggaaaatccttgtcagcgccaggctgtgggcgggcgtgtcaatttcagggagcacctgcacccctttttctgccgcaaaacgggtgagttccttccactcctccctggtcagggaaccatcctgggaggtgattccctctcccctgctgtttttcagcccggactccagacggaagcccgcataagcggtaaacgcgttgggaatggaatcgttttttccgctggtggaaagaatctcattgtcattcagatgcacacccagattattcattttgtgttcactcagagtcaggacaatctgtttcagggtttccagggaaaccatcctcctgccgatatctatatgaaaaccccgtacggaatagcggggataatcccggatcgtgccgcaggggattccctctccggcattttcaagaagatcggcggccgtgaccgttgcccagataagcccctggagcttctctgcccggagcaccatagtgcctggccggatatcgagccaatagccttcttccttcaatcccatctcttttccggcaaagcccagataaatatcccccgtctgcagggaagcttcctcaccggaaaccaccgtcagctcctcaccggacagctttttccagctttcctgtaaatccagggcaggctgcctaagctctgcctccctgtcggcctgcatcacaatgcgcttcgcatcccctggagggaaaaaaccggcgcctcccttccattccgagacctcaggcgatagccgcggccggtcatttaccacagacgcttccgcattatccacagacgcttccgcattatccgcgggcgattccggattgtccgtaaaaacggagggcggaaccgttacataataagaaggggaatcctcatatttatcgccctgcgaaatccggtatcccacggtaaccactttttcctcgagcgtgggatataccgtgccgtcctcgtcaatgatttcctcataatccgatccaagcagccggatttcatatcctgcgggcgcttcgggaaggggcaggaaacggcttccatcctccgctatcctgatttccggaacctgaaggcaccaggataccggagcctgggcgtacacttccatttccagcaaagaaacattctgataataaaggtactggttttcctccgtatcggaaaccgccgtggttctcaggcgcaggaacctgccctgcgcctgattatccaaaaccacatgctgctcattggtttccggcgtaccttcccacagggcggcctgtgtccagtgctccccgtcccgggatacctcgattacaaatcccagcacgttcagacgttcccagtaaaggctgacaaaggcaaagctctgctcctgtggaaaagaaaactgcagccagtgctccggcgctcccgcctcattggcgctggaccagcggccggcgccggcatttttctttccatccgccgccagctgcggcaggaagctatcattctccacactgtccgccgtcacctccacaccgggcatcagggccagattctcataataaaaaccatgcccaccagcgccggcagccgcgtcttctccacccagaatctctcccccgtccccgcgaagcaagacgcacgccagcagaaaaagcagcgccagcattgccagacaggctgtttttattcctggataatatctttgagttttgtcgttattctttgccatattactcctaccgctgaagcgcttttacagcttcacagctgcgtatatttttctttttcctgccaacaggtcctcagctgcctgttcttatgatccactcagaattctatccctttcctggccgtgattcctttttggtaagggtggcggacacagcgcatttccgtaatatagtccgcagcatccgtcaaaaaagcgggggcatcccttccggtgcataccacctccacagcctccggcttatgcagcaggaaatccttcagcctgccgccgtccagcagcccccaattcacagggtaggtcacctcatccatcacaaggacatcggcctttccctcctgtgcctgcaaaatcgcctcctccagaatccggttatgaatttctgtcagctcctccttctgttccagggtcatagaggaaaaaaatccgaaatccttttcactgcgcagaagcctgatttcagggatacgtgccaggctgtgaagctcccccgtatccctgcccttcatgaactgcacaatcagcacctttttccccgatcctgccgcacgcagggccagtcccatggctgctgtggtttttccctttccttctcccgtatataaatgaatcagtcctctttccagcttcatcccgacgtcctccctttccttttcacatatcgctgtcttcctgttgggacagtccttatttccgcaggaggaacacagctctgtgcaggccgtgtcccccagccgtgcctggtacaccacgctttttttcggtgaaagtacgtaaaagcggttgaaggaaaccgttgtctgcctgatttgggaaaacatcccttccatggcctccagcggaagctcacttcccggaaaaagcatcttttccacgaacagcccgtattttccccttattttttcattcagctcctcataggctttccacagaagctccgtgcagatacactccgccatatagctttccgtgagcattccctttgccgcatacccttcctggagccggtccggcccgctgccaagtgtcacgatcacctgacagaagccatgcttcccgccgggaagcattaaagcctcaccggacgcggttatgttgtcctccgcgccggccaccccggcttcttccccagctctttccccggtttctttttgggcttcttttttggcttcttccccggccgccttccatatcctgtttccgattctttccctatccggcccggaatacacataatagccttccggatccagatatttccgcacttcttcataaacctgaaaaaacagcggtaagtcggtatcctgataatgataccgacttattgctgtttgtatatcttcctgtgttaattgtggattaagttgtattttttccatactccgctttcccggtatatgcgcagccctggccgaaacgccgcaccttatcactcatcagtcaatgcccttcacctgcatggctctcatggcattgaggatggcgataaccgccacacccacatcggcaaaaaccgccagccacatgttggcaattccgaaagccgccagaataagaacaaggatttttactcccagggcaaaaacgatattctgttttacaatgcccagcgtcttgcgggaaatcctcatggctgcggcaatcttggacggttcatccgtcatgattaccacatccgccgcttcaatggctgcgtcgcttcccaggccgcccatggcgattccgatatccgcccttgccaggaccggcgcgtcgttaatgccatctcccacaaataccagcctgccctttgacgatttggatgcgatgattttctccacctcatccaccttatcaccgggaagcagctctgagtgaacctccgtcaggcctatttgcgaagccacataatccgccgtttccttccggtccccggtgagcattatcacccggttaacaccctcggccttcagcccgcggatacattctgcggcatcctccttgatttcatcagcaataaggatatatcccagatactggtcattctttgctacatggacaattgtaccaatctgcgcggcattggtaaagctaattttctgctggcgcatcagtttttcgtttccggcataaatgtcaaatccgtcaatgaccgcatggacaccgtgcccagccagctcttccgtgctttccagcctgtttttatccagttcctttccataggccttctggatggaaagggaaatagggtggttggaatagctttccgcataagccgtaagctccagcagcttctccccggaaatcacctcaacaccgttttcagaagcaggcttcacctccgtcaccttaaaggttccctttgtgagcgtgcctgttttatccataacaacaatttccgcttccgcaagagcttccagataattgctccccttgatcaggacacccgctttgctggcgcctcccagcccgccgaaaaagctcagcggcacactgataaccacggcgcaggggcaggaaaccaccaggaatgtcagccctctgtaaatccaggtggaccagcctcctaaaaacaacggcggaattattgccaggacagcggcacagagcaccacaatgggcgtataatacctggcaaatttggtgatgaaattttccgcttctgcttttttgctgctggcgttctccaccagatccaggattttggacactgtggattcaccgaagggcttgctgacctgtacctcaagcgcacccgtcagattgatgcatccgctgattacctcttcgccgcagaggacctctctgggcacgctttcaccggtgagcgccatcgtatccaggctggaatttccttttgtaatcacgccgtccagcgggattctctcgccgggcttcaccacaatcgtctcacccacggccacttcatccgggtccacctgctcttccacgccgtccctgcgcacgttggcaaaatccggacggatatccatcagctccgttatgttctttctggaacggttcaccgcgtagctctggaacagctcacctacctggtaaaacagcattaccgccaccgcttccggatactcccctacaaaaaaggctcccaccgtggcaatggtcataagaaaattctcatcaaaaacctggcccttgccgatgttgcccaccgctctcttcaccacgtctccgcccacaatcacataggctgtcaaaaatacggccagcaatacataccagggcagccccggcgcaaaattctcaatcagtacagcggccgcaaaaaaagcggctccgatgataatccgtttcagtcttttctttaatttcctggtcattattcttcatcctcctgaatatgatcaagcccctggctcagaattgtcttgatatgtccatcggacagcgagtaaaaaatagtctttccatccctcctgctcttcactaaatccatctgcttaagcaccctcagctggtgggaaattgccgactgcgtcatattcagtatctgcgccaaatcgcagacacacatttcggaacaaagcagcacatacagcattttaattcttgtagtatccccgaatatcttaaaaaagtcagccagatcatccaaatcatcctccgccggcatctgcgcatttactttttcaacaatatcctcatggacatgaatatattcacagctttccgcatgctcataatttcttttcatagaagctcctccaatcatagggtatcctttatttattttttcattcaaacatatgaacaatctttcatatgtttaatgctattatattcatctcatgtaaaaaaagcaagtacttttataaaaaaatttgattgattaaaattgggggctcatacattttattcagccctgctgctgttaaagttctgccctattcggcctttatccatcattcccatgttttccggtttctgtgtccgccagcctgtttgtgcataaagaatgaccgccccaagcaccagggcggccatcttcatgaagggtataatcaaccaataaatggaagaaagcgtaagacgctattcttcacccacctcaatttccaggaattcgggtgaatcgaaaaactcttttaatgtaataccaagtcctccgcacagcttgcagattgtaaaaatccccgggttctgggtagaacaatctatgatgtgcatcagtgtcgtcatcggaactgcggaacggtaggacaaagtataataagacatgtcctttgccgagcaaagggtcttaatacggtttgctaacttctcctgctctgacatatccggcctcctcagcttataaatacattttatcccattttttaacaaaattgcttccatatacggtagtaaaatggtaaatttttgttaaatcatgtatttattcccgaacaatgccgaatcattactacatttttatggttttcttattccgccctccatccatactgttccaatatattcctggggaattccacgcgcgccgtcatcagcggatttacgatttggcataccgacatatgcgaaaccagcgacatcagcatctcggatttcacttcctccaggccggtcacccttctcacaaattcttccatcagcctggcggctgtctttcccgcctcaaacacggtagccgccgactgaatggtaattacagcatcccgggttatcaaaaacggcgtggggattggattttcctttaatacacttacccttacggtaaccgttcccgcaatttccagcccgcagccaaaaacctctccgtctcccatcagggcatggagatcacccatggaaagcaacgctcccggaaccgcaacaggcagataaaggaccgttcccgccccgatttttctacagtccatgttgccgccgtggacatcgggaacagatgtggctatcccttctccggcaggcgccgttccgataacccctatcatgggacagcagtcaagcagcagcgtatcatcaaagcgtatcttatccccctcgatttcatacattaccgcctttgcttccggcagtctacctgcaaaaataccccatgaaaaggaagcgcacataacgcccctggaatgcaggctgatatccaggatttctactttcagcacatcccccgcatccgcgccgttaatatacaagggtccggttgccggatttcccagggcgtcttccctgtctcccagaggacgctcttcactggttacactgtcgtcatagcagtccctggtttcaaatattactgtttccccgctttcgcaaatggctgacggaggaatgtttttatccagtctgtcatataccttatccctgctgattgtaagcatcttcggctcctttcatagttcggacgcaatctttgcatcgtccggaccggtcattttcgcatcggcggcatccgccgacgtttcggccgcccgttccgcatcggcggcatcctctggcgtttcggccatccgttccgtctcttcacccccggccagccccagccccttcagaattccccagatatagggagcgccgaacatactgagcttcttcggcccgcggatcggctcacctgccgcccgcgcctccagaatctttttataagcccgaagcacggttgcctcggtaatggatttttccttccgatcgcagaaaagctcacgtcctttaatccggtaggtaaagggaagctttttgctcgtataaaaggtggttccctcataaaggcttaccgcatgccacagacagccgcccagcaatgcttcttcgccgcattcctttactgcctgtacagctttttcacgttccctgacaaaattttcgtccatactttatcctgtgtctttcctgcttttctatttttcagcatcttcccggaaaagctgtgggagaaaatcatagatacactgtctccagacattccagtcatgcccgcctctgtactccctgcgcacacagggaatcccgttttcttcacagaaagcatcgtcctccgtaaaaaaatcccagaactcatcctgccttcccatagcccggaaaaacagatgctgcttctcctggaattccttttccttcataatttccagatagctgttatccgggtcttctccgataaaattgtgcataaaaccactgaacagcccctcccagccaaaaagctgcgaataacggcagaccgtcatgcttgtctgcatggatcccatggaaagcccggccatcgcccggtggtccctgtcctttttcacccggtatttcttctcaatgaagggaatgatatcctgcacaagctcctccgggaaaaggctgtgccggagcactgcctccccatccccgtcttcctccatgaccataccgtttgccataacgataagcatgggcacggcctttccttccgccagcaggttatccatgatatggttcacctttccctgccatatccagccccgttcattctccccgaagccatgctgcaggtagagtaccggatattccagcgtcccctcttcatatcccggcggcacatagcagatgcagctttccgtccttccggtaacagcagaaggataatactcatgcctgatatccccgtgcggcacatcgtgcatctgtaaaaattccggcaccggcccaacctcaatatagttcaccggccgtgaaaagccataacctatggaaaggaacgggctgattgccagacagttgtccacgtagagatgcacataataaaatcccggctccagaggcagatccaccgtccacacatccttttccgtctccaggaacggatacatgatatcgccaatctgcagctggacattcatcgcattgggaaaacggagcctgacataaggcatgccttccgcgcggtacaaaaggccttccctggaattatggggaaccggcttaccatccggcgccgtcatcacaggccggctgtacgcgcaggattgctccactaccgcaggattatccagccattccttatcagcatcgatttgtccgcgcacctctatggttaaatcctctgtaaccgcctccgcggccctgagcgttttcaaaacgccgtccagatagcttcccagccttctgcggctctttgacagcccttctactataatatgtattttcccggaagcttccgtaagcactgcgtaaatattatcaagattttctcccctggattccggcagattcagcttttcctgcagatacctgtacagttcctccctggatcggatccctgcaaaattcaaatttatcatacccttttccctgtccctcatgttttcattcgtatcttctttatccttcatctgcagttttcctccctttaaaagccccgcagcgtttcactccggatcagtccccggaaatcgccctgcgaagctttgccttaatcctctgaagcgcattgtccgtactttttccatccttgcccagtacccgggcaatctggttatagctcatccccgtaatgtaaagatccagcacctgcttttcaaagccgcttaattctttctcaatcgcctgctccagcccttccacattttcccggtcgataaaaagctcttccggactcatttccagcgccgcaggaatggcgttcatcaggctgttttcctcattgccatccccatccggcccgatgtttttgctgtacagggaaatataggtgttaagaggcatgtgtttcttccgtgaagaggcctgcactgccgtatacatctgtctggatacgcaaagatccgcaaaggtgctgaagctggcatccctgccgctgtcataatcccggatagctttgaaaagcccaatcatgccttcctggattaaatcatcgctgtccccgcctaaaagatacatggacttggcttttgccttcaccatgcccttatatttttccataatgtaatccgtgatatcattttcaccgtccctgagaagcacgatcagctcctcgtcggtatattccccgtaggaatctttcattgggaatccgttcctttcttctgcctcgactgcagaatccgtatcaaatccgccgccacatgctctcccagaatctcatagccctccgcgttgggatgtacgccgtccggcatgaaatgcaggacattgtctttatcatgtccgtccagaatattagaattgtaaaggtcaatcacttccattccatgttcgtccgccagctccttgatgacatccgcgaatttatcctggggaatcaggtaggggtgctggattttcaggtaatcctgaaggctgttgggaagaggtgtcatgaaaatcacctccgcattgggatagtccgtcttcagcccatccatcagttcatccaaatccccccagaaggttctccttttacgctccgcggaatttccgaattccaccaggcttgcacagaactcgtcatttgtgccgcccattacaagaatgatatcgctgtcctcagggattttctggtagcggtctacaaaggcgtccgcccagtatctcccgatagaagagcctcctattcccagattatatacttttctggcatccagcgtttcctgcaggatatggggataggcaagctcctgataattatccagattatccaggtttacggcctgggtaatgctgtcgcccagacaggttattttgatatccgaaaaatcaatgttgtttcctgatatcgtctgtttatccagttcattggcgagaagcgtttccttatgggagctgcggacctcctgccgttgggccagggtgtagtgtttcctgtcaaaaggatcctccagctttgccgtattccttcccatatgagctatgatatcactgtcggaaacagaattgcctgaggcactgctgcctgaaactgagttgcctgacgtactgctgcctgaaactgaattgcctgacgtactgctgcctgaaactgtgctgtcggaggaactgcctcccgattcttctttgccggattcacttccggaggagttttccttttttgaatccttatttccacctgtgctgttttgggaaatgctgtttgcagatatactgttgccggaagtgctgccggacagggaatttcctgaaatatcattttctgaaatactgctgccggatacgcttcctccgcaagggcggagtaactgccttgcaggaattctgtttcctgaaatctgattctcaccgccgtcactgccggggccgctgttgccagacacctggtttccgcttacagacgctccactgttatttcctgatacctgattttgaccggcggattccccgttgtcatttccggatacctggcctgcatctccggcttctgcgctgtcatttccggatacctggcctgtgtctccggcttctgcgctgtcatttccggatacgagactttcatctctgccttctccgccatcatttccggacacctggcctgtgtctccggcttcctccccgccgcggtccatcgtctgtcctgtgtcctgctttccgtctgccgcgccttcggagtccttgccggttttcgccgtcgcctcctgggcctgtcctacagactcatgcgacacagaatcctgcaccgacgcgccggaatcatcagccgcctgtcctgcatccgctgatccattttctgttttatccacggttcccacgctctgcagcccgccgctgtccgcctgcatgaccggagcgtcggccgctccggactgcctgctgcatgccgctgtaaaggaaatcaggaatacagccagaagaccgcatcccgtaaccgccagaaaattcaaatttttcattttttcttaatgctcctgcaatctgaaggaatgttgcctctgtagctgtgaagggttcaggcagttaccttccttctacctttttatataagtctctgtctgacaatctcataagccagcacacctgccgccactgaggcattcagggagtcaatgtttcccttcatggggatggacgcgacaaagtcacagttttccttcaccagccttcccacgccttcgccttcgttaccaataacaaggccgattgcgccagtcaggttcaaatcatacattctggttccgtccatgtccgcacacacaaaccacattccttttttctttaactcgtccatggtttttaccagattggtcaccttggccaccggtgtgtaattcaaggccccggcagaggtacgggccacggttgcggtcagacccacagccctgtttttaggaatgatgacaccgtgggcgcccgccaggttggcagtacggatgatcgcccccagattatggggatcttcaatattatccaataatatcaaaaagggcggctcctgcctttcctcagccagcttcagcatatcttctacctgcgcgtattcataggcagcggcataggcaataaccccctgatgttttcctgtttcagacatctgatccagacgttccctggaaacatacttaatgagacaatccgtctttttcgcttctcttttgatggtcataatcggaccgtcctgacagttgtccagaataaaaactctgtcaatggtctttcccgaacggaaggcttctataaccgcattccgcccttctatagtcagttcttcgtatctcataaccgctccttcagtttcgctccggcaggtcacaccagaacggatttttcatactctttttattcagagagcaagatcaagctccctgagtgaaattttcaccagctccatcagccgttccatccggccgtccaggtaaaggtagccgtaaagcgcctccaacgcggtggccttccggtaatcccctacggaagcattcttggccgtggtataggacttggcattccgcccccgcctgtatatggcaagctcctcctccgtaagatactgctgcaaaacagttcccatctccgcctgtgtctgcgccttgaccagatggcttttttccttatgcagcctgttgggggatgcattatgccgctccaccaccacagtcctgataatgagatcgtaaatacaatcccccacgaaggcaagagtcaggggggagtaggtccgaagatctacttcccccaggttgaattcttttttaatctgcgtaagcaggcttaagctctcttccattttactccctcgcgggtatcctccagaataattcccctctcaagcagctcatccctgatttcatccgctctggcaaaattctttgctttcctggctgcctgacgctccgcgatcagcgcttccacgtcctcatccagcatttcttcctttttctccacgataagcccgcagacatcggccagctccttgatttcctccagcagcgcttttatataagcggcggaattatccgcgccggcattggtattggcaaatttcacaagctcaaaaatagcggcaatggcgtccgccgtattaaaatcatcgtccatggcctcgtcaaacttcaccgcatatccggcagcctccttaagaagcttcttctcctcttccgtggcttcgcccgcgcccgctttttccagaaggaaattcaggttggctgccgcggtacggattctgtccagaccgttcttggccgcttccatcagctcgtcgctgaagttcagcgggcttctgtaatgagcggaaagcatgaagaaacggaccacctgcggatcatatttcgctacaatatcacgcacggtaaagaagtttccggcagatttgctcatttttttattatcaatgttcaaaaatgcgttgtgcatccagtacctggcaaaggtcttgccgtttgccgcctcagactgggcgatttcgttctcatgatgaggaaaaaccaaatcctccccgcctgcgtggatatcgatctcttcccccagatatttcttgctcattacggagcattcgatatgccagccgggacggcctttacaccagggagactcccagtaaggctccccgtcttttttcggcttccagagtacgaaatcaaagggatcctccttctgatcctcgccggataccagcagggaacgcttgcctccctccaaatcgtccagattcttatgggaaagcttaccatattccttaaaacttctgacacggaaatataccgtgccgtcctccgccgcataggcatgccctttgtcaatcagctcctgtatcatatccagcatgccgcagatttcctgggtggcctggggatgggtggtggcaggcttcacattaagggattccatatcctttttgcattccgcaatataacgctcggaaatcaccgtggaatccacgccctcttcaatcgccttctttatgattttatcatccacatcagtgaagttgctcacataatttactttatagcccttatgttcaaaataacggcgcaccgtatcaaatacaatcatcggacgggcattgccgatatggatcagattatatacggtggggccgcagacatacattttaacctcaccaggggtaatcggcacaaattcttcttttctctttgtcagggtgttgtaaattttcatcttgactggttctcctttttcatattctcaaataattttatcgtaactgttcaggacgctcagttttccgtctgtttctccccgcatgacacgggacagccctcctgccccttctgacagcattttatcttctcgtgacaccgttccttctgccggcaaacctcacgataagcgcattttccttcctcacagcttttttcctctgttcttttaaggtaacgcacttccgcctccaggtcaagcagtctgttgattaattcactgtttgcatgctgaagattggaaatatcctctttcacagggtcaggcagattgacctgatccatggtatcacggggaatcggctgatttccccttttcaccacccggccgggcacccccaccacagtagaattgggcggcacctcctccagcaccacgctccccgcaccgattttggaattttcccctatggtaaaagaccccagcaccttggcgccggcgcttatcataacattatcccccaccgtaggatgccttttcccatgctctttcccggttccccccagcgttaccccctgatataaagtcacattatccccgataatcgccgtttccccgataatcacaccatttccgtgatcaataaaaaaccccctgccaatctgcgctcccggatggatttcaatccccgttttcctgacccccctctgcgaaatccaccttgccagaaaaaaatggcccgatcgatacagcttatgagccagcctgtaatgaagcataaccttaaagctgggataaagaaatacctccatcgaagaatgtattgcagggtcacgctccctgataatcctaatctcctcttttatgtttcctataatacccatttaccttccttctttccagggcaacaaataaaccgcggttccttcccttctctgcaacagagacggttgaagccgcggttccactctaattcaggttaatacctgcactcaaaacgcgtaacgtgcgtaaacgtaccaggctacaggaaaactcccctcacccgatcagctcccggaggcactttcagctatatctgccaggaatgcttccagccggtgacactccctctctgcggcaaaccaacaacctactctttccgttcatcgcctttttccttcatttgctatctatatacaggatatgcaaaagtcctttttttgtcaacttctttttacctattccttctttttacttattccccccacttaaccccctgacacattgttttaaactctttatcaatcaatgctaactcgtataatccctacgtatctatccatttccactatccatcttccctacacctaccgcctgccaggccaaacgcatccgcgacaggagaacggaactggggcgaatgcgtttggccctccccctcagacaatttcgttgatgcatacgtcgcggagggttttgatacgttccagcccctgcaaaagtccctcccgctcccaccggtatccatttctgaagctgaagcattcttccgccggccttcttccgaacagaaatgcggtcagcagctcaggcgaggtttccgcataaatctgctgtccgacttttccctcgtccattctgcacacgctgctttcgccgggaccggtctgccatctgaaaaagccattgttttcttcaatcatgctgtcctcatatttcagcagcacatccaggttctgcctgcaacggatgaaagaaagcatggcgggcagactgataatccttcccataattgccggctggctgacagtatccggctcaagcacaagctcctcaaattccgggtaaatcaacgcctcctgtatcaccgggcctttttcccggctgtaaaggaaatagcccacaatccgcttatcatccagaagcaggaaactgtccccctgctgggcgtacatttccttcagcatcatttcatagtactccgcggagcgttccgtatatacctggaacctgcgctccagcaacggaaccgcaaaacgcaccacctccgggatatcctcttcctccatgggcctgacctccagcataccgtatcccggctgttcttttttctccaggacattttccgccgcctgcagtattttacgtccgtcccggataaaaataggttctctcgattccccttccagcaggtcgtccgccatcaggccgaactccggctgaaaaatccactggggcttgtcataaatataggcaaattggaaaggctcataaatttcaggcgccgcaggctgtaagaaggcaaacggctgtccggcggcattcaattccccgcaggcttccttcagcagcctgcccatgaagccgtgcctgcgccactcctgtctggtcgccactcccacaagataggtagattctaccttccggaatataccatccgtcttcacgcagacctgataaggcgtcatggaaaccatggacagcagctttccatcctcctccagtatcagggcgttgtttttttccgccttattatcaaaataatagtcgttgaacagcttagtgtcttctgcaaaagcttcttcccacaattcccttaaactacggcagccggcagcctccagccgtctgatccgctgcttttgtaattccatccctttatccaaccttcttcattatttatgccttcgggcagcctccgcacccggcgcagcctccgttcacatcctgggaatacaggccgtagggtgtattcagaaggcagacggcctgggaagaaatgccctctcctgtcccggtaaagccaagcccttcctctgtggttgcctttacattcacctgatccacctcaatttgcagcgcctgcgcaatatttttacgcattgtatcgatgtggggacgcattttaggcgcctgcgcaatgatggttgcgtcaatattttcaatcagaaagctgtgttcctccaaaagttcgcccaccttacgcagaagctccatactgctgattcctttatacgcgggatcggtatcggggaaatgctttccgatatccccaagcgccgcagcgccaagcagggcatccatgatggcatgcagaaggacatccgcatccgaatggccgagaagccctttttcgtaagggatttccactccgccgataatcagcttcctgtcctccgtaaggcggtgtacgtcgtagcccattcctattctcatgtgttactctccttaataatctgatcttttcaaaatgcatgtcgcagcttcagcctgctctgcaagggaacaggctgaaaccggactttaatgagagtataccacattttccctttaaaaaaatcattttgaggagattttttcgattacatcagctgctttctgcgctcctccggcttttctgaagctttctccgattccgcccgcggccacacgaaaccgggcattcttcaaaacctgcaggatgctttcccggattacggaggcttcccttcccggcaaggggattccggctcccacctcctgtacacggcgggcaaccgcgccctcctccggctgctggggaaacaataccataggcacgccgaaatacaggctttcgctcacactgttcatgccgcagtgggtaagaaatacatcagcctcctgaagcacctccagctgattgaccctgggtattacctgaaaattatccggaataactccgagtccggaaatatctgtacgcccgcctactgacataatgacatccacagcttctgttttcagcgctttcatgcagcttatatagaaatcctcctgcctgttcagcacggttcccagggatatgtaaaccagcggcctgcttttcttatgtcctgacggcttcgggaccgcaatggaagggccggtgaaggtaaatttatcggaaaaggtttccgacatgggctggaattctttcgatgtataaacaatggtttccgtatcattatcattttgtaacagctcgtaaaactgccggatttcataaccatggcggcgcagctgcctgagcctggcattgattcggggcatcccggacagcatacgcagaagctccgaaaggctctgcttcataagacgcgccgtctgctggttaaatgcaaaggtggttgtggagcagacgaagggaacattcagttttttcgcatacagctttccccagatacagatggaatccgatactatacaatccggcttccaggcccgcagctcacccagtaccttatcttccatggcaagcgttacatccacagtcatatccaccagggaggacagatcctttcctacttttttgtcaatatcttttggagcgggaggcataaaatcatcgcagggtatgcagacggcgcctgtttcttcaatacgggaccggaactcataaaaggaatagtaatggacctgatttcccctttttaccagctcacggacgacctctatggtaggattggtatgcccataggcaggaatacagaaaaatacaattttactcatgtcacagttttcctttctttcacatatgcacttttgtattaaaagtattacttttcttactttttatacttttactatagttcatataagctcggatgtcaatgaaaataaatcaattgtacattatttagcttgacggttcatgtaatctctgctatcctcaatacaaaccaaccgtcggtttatatggaggcattatgggaagaaacaaatatcctgaacaaacagttgagaaaatcataattacagctgcccggcttttttcagaaaaggggtatgagcagacgagtatccaggacatcctggacgctctgaagctgtccaaaggcgggctttaccatcacttcaagtcaaaagaagagattctggagactgtcatacagaagagggcacagtatgtttttgacagtttccatgaactcattcgtaatactaaggctgaaaatgcaaaagagaagctgaaaaaaattcttttacagctcgcggatgactcagaaacccatatgtttgataaggtgttatcatcgcaggtcaatccctatttcgtagtcggaagcatgcaggcaagtatgcagcaggatgcgccgactctctgtgaactgattgaagaaggcatcagggacggttccctgcagacgacgcagcccgccctttgttcagaggtttttctgatacttctgaattactgggcaaatccggtattgttcgggcgtaactgtgcggaaacaaaagaacgtctgaattacctgcagtttgttatgaggcagcttggcctggatattcttgacgataacataattgcaagccttgccgaggcttatggctgatataatatatctgatgattttatctggaaagcttggagccgttttttcttgaaggatgtaaaaatgactgttgccatagacggtcgttttttttaacaatataaagaccgacggtcggttttttatataagataattaaatatcatattccaggaggaaaaggaaatggatcagaacagattacaagaaagcacaatgaaggcagcaaagaaaccattggaattaacccgttccgcaatggtgcatacgcaaaagactttggaaaaaacccaggagcttagccgttttgcagcggaaaaatcaaaaaaactgcgtacaccgtcagcaaaagccgacagaatcggaactgctgtgggaggaattgccggggcgggcctgctgctgggaggcgcagtttggatgtgtatcggaaagcctgcgtatgccgccggggcattaatagcaggcgccgctgcgctgctgtctaaccgcattcattattatcagatgaagagggaaaaatagggatctgggatacccagggaaatctttataaaagatgcttttgagaattggtgcatctatggcagaagattggattatttcaaaacaggacagctaaataatttgtgtttttaatttcaagaaggccgcggcagggatatggcatcactgccttaaagccctcccggcggccgatatcgtgcagaagctccattacatacgctcgttcgctgtccataccgttgattttgactgcaatcagaccggcattttccgctacagaaatactgtgccgcacccaggggcccggcattttttctgctgccaaatcaagctcccgtcctgcctcctctggtgttaacatattcattcctcctgatttttcccggggaacatatcatcaaacatctgtcctgtgctgtcataaggaaggatgccgattccctgttcttcatccgcaagcaaaagcagcatgtcccccggttcgatctgaaacatatcccgtacctcttttggaactataatctgtcccttcggccctaccttgacggtagccacaaatttacctttcggcggtttaagctttgccatggcaattcctcccttttatctgatacaggaaagcaggccttcggcaaatgccgccgctgtatactgccttccattttctcatcagtctggccggcatgaaaaattatttttcccctgcttccggtcttacttgtaagaaaaatcgtaccatcatttacctggcgcgtcaacccgaaccactttctttttatctttctttttatctttccttttgtccttctttttcaacccaaataaaaccttcagcacaggaattctcacaaacagttcccccaaaagcactgccgacgccagtgaaaaaacaaatgtcattatataattcattatgtatggaagagcaagcttttccgaaagaaaccatgcagcataaatcatgggaacatagtgaaaataataaatgccgaagctgcgggtgctcatccgggacgtaaagcaggtgcttcggttccaccaccggccggcggctcccagtattgccagaatcatgagccaggtataaagcatcaccagccagttattaaccacagcctgataaggcttcccccaggaaacggccgtctgcgccacacctgctgcaagccccgccgcaagcagcagaatacagtacttttgcaggctccgctggactctgtcatgagaaaatacataatatcccaaaagaaacagaagcagatacagtccgatacggaaggtataggcaatatacagaagctgagccgctcccaggaccggcagataaaacgccagcagtacaggaatactacagcgttcgccccacgcagaaagacgcccctttttatcgactttccgaaacagcactaataccaaagacagtacaaaaagctgaagaaggaaccaggaggggcccatgccattaacgatccggatgcagaatacgattggcgcaggcaatgccgcaaatacctcctccatgtggttcacccggaaggaaagtcccgatgcaaacggcccgattaaaatcagataggaaacaaaaggcaccaacagccgccataccctctcccggatatattcccttccgcactttttgctgagggaaaagcgggcgcatataccgctgaccacaaacagaagcggcataaaccagggataaatcagataaccgatggcatccatggctggtatacccggcgcattatagctcatcaccgccccgcagctgcagtatatgctgaccacatgaaaaaccagtaccagcgcaattacgctccaacggatattatccagataatattttctcattgcattccctccagtgaaaggcacataacgcctgtattccttatcctgctgtacatcttgtcacatatgtgtcataatcaaaccatacaggaggttcgccccaaaagcaatccttcagagaatagtgctacagaaatgaaatatatgtgacaggagtcatactatgaaaaaaggacaatcccatcccgcatccgccctttcccagaagcttctggcggacggccttctttccctgctggagcaaaagcccttccgggaaatcacaataaaggagctttgcgctcattccgatattgcaagacgcaccttttaccggcatttcagctctgtggaggatgtaatggcatacgtggtttcccacatcattgaaaattttaaggaacatatgttactggtgcagaaagaggcgtatcccgccattctcgcttcttactttgctttctggaaggattacgcctctttgctggagcttcttaacaaaaataatcttgcccacctgatttttattccctacatgcaaagccttcccggactgccctggctttttcctcccggaagctttcccgacagctttcccgacagttttctccgggagacgccggagggtggagaggatatggaggtcctaaactgccggctttcttaccattccggcggattatggagtgtgctcacctattggtgcataaatggctgccgccagccggcggaaaaactggcgcagacactgtgcggaatgctctgaatggcatccggtacgaaaatattttaaccctagcctgatgacgtgggcggtctgatgattttttgctgccagatccaggatatcccttccctgggaattccggtcccataaataatatcaaactccgcttccttaaaaggcggagccacctttttttaaccaccttcaggcgggttctgttcccgatccgttcccacagatttttatcatattaatccgccttacatcaaggcgcaccgaggcatagaatttcagtgcccgccggtggttgtccggtaaatctcccggtttatcaccggatattttctgaaccgttctgctgtttccttctcttttccgccattcatagttgccctcccttgtaatttcctatatactgattatattaaaacctgtaactgtatagtttttgtaatatgccactgtaaaccgtcagggaatatgccacaatttttgtaaccggacatatgccgcaaaagagaaggaggatccttatatggatattgaaatccgcaaactgacacccgatctggcagaggattatgcatactttttcgatgttactcctcacgatatcaacgtagacgaagccaaatgctactgcgtgacctggcgcagcgatgcttcctatgcgaacgaagggcactggtttcccactcgtgaggatagaagggcgcatgccatccacttcatcaaaacaggcagccttcagggctatctggcctattgcggtgatgaaatcgtgggatggtgcaacgccaacggggattgtcaatattgcctcgattacctgcgttcctcctggccgattgaagaataccgagaggatgtcagagtgaaatccatattttgctttgtaattacccccaggctgcaacgacaggggattgctacgcagctggtggaacgagtctgcatggatgcggccggtgaaggttatgattttgtcgaggcctatgtaaacagcaatttcattgacacctgccaggatttcagagggcctgtcacgatgtatgaaaaatgcggatttgtcagattcgctgaacgggacggcaaaacggttatgcgcaaggcgctcagacagcaggtatagaaagtatccgacacagaccggctgctaaaaaaagtcagagctaataaaaaaggaaggcaaaaataacatggatttgacattaaaactgaatgcacgatttcagccaaaacacagatttgagctggaggatgccctgcaggaaattctggaaaaagagcaggcaggggaggttaccggaggcggtacggcacaaaacccaaacggtgaaattgcatactgcgatattgatatttatttgacggaggataccccggaacgcctgaactggctggtctctctgctcaataccataggcatccccaaaggcagcgttctgcagggtacaggacctgaaattgaggtgggaaccttagaggggctggcctattactctaacggcgcggatttgccggatgagatttaccagacctgtgatatcaattatgtgattgagcagatggagcaggccatggagggcatcggcaggatgtacagctattgggagggcagtacatacaccgccctgtatttttacggaacctcctttgctgaaatgaaagaaaaaatagagccttttattgcctcctatcctctgtgccaaaaaagccggattgagcagattgcttaattcctgcttacatttgcctgaatcggaatggtaggaatgcatttcttataaaaaaacagggtgacagcatgatttggatatgaaacagacgggcctgaagacgggtttgattttaaacattatgactgacggttccagttttcaggatgttcgtcagatttaatgcagggagcagggttgcatatgacaaatgaacaaagaacggaacaaatcataaaaaaatacggatttgatttaatcaatatttccaaagaagaaattatcgatctgctgcaaaaagaaattgccgattaccagcccggcagttccgaatacctcagggtactgtgcggctatttatactgcatgggcgatatttcagacgttcccctgcttgaaaaagcgaagtacagcattaatatggacgtgggctgcatgattgacagcgagtggattgacagcctgaaaaacggtggaatcagctcccaatatatcagatccaggcaggaaatcattgatgacttcgtactgtattacaaagattttcaggccgaagaggaagggctggaataattcactttaccgggcatcagcgtcaggaagcgctacagcccggaagcttacgggggtagctatcatggaatggttaaatatattcggcctgttcttcatttctatcattatgattccgaacattatctatgcagttcaatgcagggacgactttattgatgtttggaaaaacaaaaaaatagaatttctggaacaggttggccgttttggctgcttcgggacaatgataattaatattcccggcacctgtcatggctttccgtcagacgaagcattcgcaatgtatctgggaattaatggggtactgctcttcctttactgcctgatttggattatctgcttcaggaaaaattcgcttttcagggcgctggctttatccatcctcccctccgcaatatttctttccagtggaatcttaagccgctcagtcctgctcacagcggcggcagttattttcgctccctgccatattttaatcagttataaaaatgcagatcccataaaatctgcgaaacaaatcaaagacctcgctgcagagcagcggggtatttgaccctcgcggcagtcgccaaatatccaaccaagcatggctacttggctcgttgctcgcgggaataaacaacaatttttctggtaaataaaatgaagccgggcttcaagaggttacacatggaaattttacttttatgcctgaatgcttttgaaaccatggagttcggcccttttgttgatgtaattggctaggcgcatgatgatttcggctgtgatgtggaaattgatatctgtggttgattgcatccgtctgtgtggccgttttcccgatgtcaaaaagcggcgttctgaagggcaggaaagcgaccacctgccgtctgtgctgaggctataaaaggaaggaattggaggagtccggcgctgttcctgaaaatgattggcttgttgtcgatggcaatatcatcacctcctcctgcctgaaaaccgctcccgaggttacattccgattattggaaatgcttacaacaaaagaaaaagcccatcagatccgtgaggccatgggcttttaaccgaacagtttgggaggggaatcgaaatgaaaatactattggtttccatgttccaaaatgttgccggattcttcaacagcgcaggctgttaccggatctcttcaccggtaacggcattgatgaacattattttcttatagctgtctgtttttccatcgttcttttcccccttggcaggcttcgcagcgtcatactgtaaggtcaggctccatgccggaaccagcttaacgtcctcatagctgtcattatagggcgtggggacatattctaaatcagcggccgtgactgtgattttatccgtagaattactgccgttacagatatcagccgccttctgcagcgcctcttcggcggaaagaagctgatctgccgccgcgtcagtactttgcatctgatagatagcgctgtaacgcagttccattatccccttctttgaaaaagatacttcaaccacggagccttccatgcctcgttcatttgcctgagtcgtgtaggttttctgcgttatgggaatgttattgtccacaaccttgaaatagaaccggtagaaatcgtcatccgatgtgaacttatcctttgtctgataaccatatgtcggatcattttctgatttgtcatccgccggcgttatgccaaacgtctccatatattccgacatttctttgattcttttatcctgctgttcctgcatagctgccgaatcaatggcgtagcattccacttcgtccgcaacgtcaattgaaagcttattcaaaacaaggaaaacagcctcaagggcttcttcctttgtcataaagcccagattttcctgtctgtatacctctcccagcccggctccggcagaattgatatcgtaatccgccgagaagctgtctgtgggaaatttgtaatatgcacagtcctttgtccggtagtaaagggtgcccggggttaacagcagcgatgcgctgccatcgctgtaggaaatgccgccgtctgccgcagccgcttccttttggggtgttttgccgtcaaacaggacggatactgccttctgttcgtcaaaccacatcctttttgccgtcaggatatgggcgctgctgatatcaggcgcaaggacatccgcatctgcagaaaaattaccgccataatctttactgatatgtatggttgtgttccggaccgattcaccggcagttagaacatcctcctgtgcgtccggcgtatttgtctctgctgcacttaaccccggaacgtcagacgccgatgcatcagactccgatacatttgccccttgtgcatttgcctccggcgtatttgacgcccctgcatttgaaccggccgtgcctgccggggccttcggcccacaggccgtcaggcccaaaataaagaaagcagcgattaaaaaactggtacattttttcatattgcgcatcatattgcctccctgaatcagtattccgaatttatcggtaagtttcgagaatccgtccgttgctttccggtaaaaaacctcctgccgcaccggacatttccagtgtagcaggaggttttgtcttacttttcaccaagttgtgtcaaagttgtcaaatgctctgttttttattcataaagccggatgctgaagaaaggcgtatattttttctcatcctgcaggaactccactttaagataacagtgttccccctgtcccttccaggtatggattcttcctgctgtccctggctcctcatttacctccatttgccgggggtacaggtcaatccccaacatgtagcgtgaattgtatgcccctgctgccgctttccagaaaagatcgtagggctcacatttggttaaagggatcccggcatggctgatgtccccgcaaagatacacaggggtaccggttacggcgtccaggatgacctcataattccccagccctatcctccaaagggaaagcgacgcatcggaggatgacaggagaagactcgccccggaatacgcatattcagctgccgccttttctgtactgcgggcggcgtcggcagaactgtcgtcaaaaaaggaatagccgtactccgcaaagactgtctgcatatcgttcaaaaatgactgtgcggcgctgatcgcattttcctgcgtcagttctgtatccagcggctcccttgtatcgataagcagtgcatcggaggtatcctctcccgcagcaagcagcgccgtcatttcggataatcccttcatccgcccggcaagcacctgcgcgtttatttcatcatagccgtacagggcaaggctttccgccctgacattaccggagacctgcagaagctgtgttttcagccgttttatcatcaaccggggaagaacaaggccggaagagatcaggagaactgccaaaaggaaggggactattctgtagatgcctttatgcttcatcaccttccgcctcctttctcagcgtaaaggaaaccgttgttccttttcctgtttcactgacatactccagcttcgttccatgtattccggcaatgcgcgcacacaacgcaagccccagccccgcgccgtgttccctgcgggaacgggacttgtccaccatatagaaggcctccgtgatacgcataagctcatctgatggaatccccctgccatcatccgatacagacacgcagtaaagctccttttccgcgcgtcccagcagtgttacgtgctttccgccggatttaagcgcgttgtccaggagatttaacaaaagggtcttaaaaagatcatattcaagcctgacccaggcgggttcggcctgacagacaaattccacgcctcttttttccgcggacggcagtaaagaggcttgtgcatcctgcattacagttgtgatttccgtttcctccagcgtaaaaccggtttgatccaatgcgaacaaatccatgagcttgaaggacagcgcttccaggcgcatcccttcattcatgataaaccatgccgcctgttccgtttcttcctcagacagcttcctttgatatatcatatccgcatatccgatgacagaggtcatgggcgtttttaactcatgggcaaaattggcggtaaaccgcttctgccggcttgccgctgcttcaagctcccgaatcttttcctcaacggtatccgccattttattataatcctgcgccagcccgccgatttcatcccttgcatggatgttcgcccgaaagctgtaatccccgtttccaaaagcgcgggtagcgcggcgcagaatggtaagcggccttgtcagcgcccaggacagccccagggccgccgctgtgcttgctgcaagaatcagaaaatacaggcgcgtgcattgtgccagcagattttccgcttctgaaaaaacctgcgatatgtcctgctttgtcacaaggaataagcgccgaccgctctgcgtaaattcactttttataatcagagaaacggcgccgtcctctcttaccacctgataatttatgtatccctcctgaatatccccaaaatcctgcggaaaggcgagatcggaataatatatcccatccgcttctccggctagcagcaggccgcctcccgttcccaacaggccggcagcattttccccaatggctgaaagccttggttccggtacgattccgccgctgagcgtattcagaattgtggactggatggtatgcttgataagctgatgctgcataagcccgctgtcctgcgcccggcggaaggagtggtttaagctgaatgccacgcaggaatattccatcactgccagggctgccgtaagtatcagcgttatgctcagaaaaaacttatggaaatatctcactgctcctgttcctccagacgatatccgatgcgaaacacagtcttgatttgcccgttccaccccagcttcttccgcagcttctgaatatgggaatccaatgtccgggtttcgccggtgtactcctcctgccatacggtttcatacagcttctcccggctgagaaccacatttttatgccgcgccagttctgcaagcaggtcaaattcctttactgttaattccaccagagtcccggctttccatacctgccgtgatgcgggtgaaatgagcacatcgcctatctggattttttcattggagtgtccgctcctgcgcaggactgcttcgactctggcggcaagctccccgatctgaaaaggtttgcacagataatcatccgcgcccaaatgaaggccgcgaatgcgatcctgcacctgtcccatggcggagatgataataaccgggatttgggcggcgcgtatatttcccaaagaccgtatgtattccagcagatcatagccgcttatttccggcagcatcaaatcaagcaggataagatcatattgcctctgttcaatgagatccgcgccttcctttccgtcaaaggcacagtcgcagctgtaaccgtcagccgtcagtgtgctcctgattaaattatttatgggacgctcgtcctctattattaatattttcatcgttattttcccttttggctcacaattccaggtatccttgtatccattttatcacgcagatgtgtcaaagttgtcaatttgccgctgttcatttccacagattggccggtgtgtcaaaattataccacaaaacccaaaccgtccgcgttccatattatgtatttcagggcaaaaaaatagacacgcatttctgtgtctattctttgccgcaggctcgggctttgcaggcgccggacggccttctgtccgccctgcagccgggcctgtgccgtattttattttttcagcaattctttgtagatctccttatccttatccgcaaacacattaaaaataacctgtttcacagaggaattaccttccaggaagcggcataccgtttttactgcaatttccgcggctatttcctggggaaaatgaaatactcccgttgaaatgcagcaaaatgctatcgactccagatgattttccgccgcaagctccagacacgacctgtagcagcctgagagcagctcacagtctttgcggcggagcggaccggaaataaccgggcctaccgtatgcaggatataacggcaggggagattgtagcccggggtaattttcgcagagcccgtgggttcctcatgcccctgttcgcacattatctcattgcattccaggcggagctgcactcccgcaagggagtggatcatattgtcaatgcaggaatggcaaggtataaaacagcctaaaagcgcactgtttgccgcattgacgacagcgtctgcttttaagcgggtgatatccccctgccacaggaagatccgctcatccaaatccgatgggataagcccatggcaatcaatgatcccccgctgtttaaccatttgggataaatatgcattctgcacctctaaaaaggattgggaaaccggccggggcggccgcacgttcatcagggaacggattaagcgccactgttcagcttcaccctccggaatttccacaccgccatattcgggcatatcctttatcaggctttgaatcaggtaacgcgcctgttcctcctttgacattctaaatcaccttccttctttcccagtttctgccagttccttcagcacctgtgcgatatcttcgctgatgcagatcgaacgctccttaatttcccatggcgcacaggcctctgacagattgatgcacacataagcggcggcagggtttttatcggtcatctgccagaaagggtatttgatgatgcctggcgtattcattcccacgcccagctccagataaaccacccttccctccttattttcacgaaggaaatcttcatagcggccgcacgcgcgcatccacgcctcatcctccacgaaataaccgtcgcagcgcagattcacctccatatctcctccgcataccggacatctgggaaccaattcggttggaatccggcagtttttctgccgggccaccatggctctgacctgcgtttcattattataaagctttttatggcaggcttttgcacattggaacaggccgtaatccccctgtgtggcaaaaatccgttcgtccgggaaaccggccagccagaactgatgatccacattggtggtgagtatgaaataatttttatccttcagaagcgcgtacagatccagatagggttttccgggcgccacatcataacggttatagtaaatatgcctgctccagtaagcccatttttcttcctgagtaggaaacgggtaaaaaccggcggaatacatatcccttaatccgtagcgttctataaattcacggaaatttgccgtaaaacgttctccggaatacataagccctgcggcggcggacaggccggaacctgcccccactacaactgcatccgcatttttcagaagcgctgccagttccccgattggcccgctgttcctttttattctatgatacaatcctgtcggcatttttctattcctcttctatccttttgatggcctgtaccggacagacctcgctgcacaggccgcagtgaaggcagttttcctctttgatttcaaccggatttttttccaggatacagccctgggggcaggcctgaaggcatttcccgcagccgatgcaggcctctgtaaccataaatccgccgcctcttttggcttcttccccgattgtatagcgttcccggaatatggggtggacacccaggttaaaatattctatcactgcttttttcacgcagaatacttccagaacatatcggctgtttccgggatatacgttattcattatctggttttcttcaaagatacggtccagccattttttctgcctggtatcaggcaccctttccggaatgccgttgacgcggatcatttcctgataacgggtgagcgccgtgatggcgacctcttttccattctgcagctctctgtaaaaattctttcctctggcggttacaaaataaatttctcctttttccggttccacatgcatgatattgataattcgcacctggggatttccgtgagcatctacggttcccatggatgtgctgcatacatagcgcagttttcgaatacaggtttgcgcgttcatcggctgctcctttcctttttgtccttcccgaaaatgcctggagaagcttcctgtgccgcttcaggcatttggggatgaagttgttttccagcactgcgggtcgggcgcgtacatatttcccgtatagccgaaggttaccgcggggcagcctctgcagaagcggagaagttcacagccggcacacttttcaaagctgtcatattgccgatactgatccattttttctcccagaaacagatccgccatgctgtccgtcagggcatttccaatcctgctttccatcctgcggcaggcatagacatcgcctgtgggcagtatcgtcatatggcagatgccgcagtggcagccgtcataaatagtgtctggtttcaggttctccaggattttgaatattcccttttcataaaggaacagggtccacaggtgatctttgagctggaaggtggtgccgcagcccttatattgttcaaacttttcccagcatttttccagatatgcccggtattccaggggttccatatggaattccgcgcttttttcctcactggtggggcaatagcggcccacggcaaaaacatcggcctgtttttccaccactacatcaatcagcccggggatttcctccatattgcttttagatacggtggacatgatggcacaatacattcccgccctgcggatgcagctgattttttccagggtaatgtcgaaggagccgggcttacggaagctgtcgtgggtttccctcaatccatccagggaaagctggtacttacggcagccataatcgtagagccggcggcagacttcatcattaagatggaaggggtttcccagaatggcgaaggtgatttcatgctttttcagcagttccagcagcctccagaaatcagggtgcagaatggggtcgcctccggttatgtaaaaatacggggtgcgggacagctttccgcacatatccaggcagttgtccagcaccttttccatatcgctataggacatctcggccagctttttgcagctgtcttcagaaaatatgtagcagtgcctgcaccgctgatcgcagttgtctgttatgtgccattgaaaggcgaaataagggttcattctgtattcctccggtatgtgggctggctgttatggtcgggttatctatggcggcggggtaggattggtacgggccaggacgggattttacctttcaggggctgatgcgccgcaggggaaattgcaggcgcctggtggctgctccggatctgaggttccgcaggtagaactacaggcgcctgatggctattgcggatctgaggttccacaggtagaactacaggcgcttggtggctattccggatctgaggttccacaggcggagccgcatgcacttggtttcttttccggatctgtcgtcccgcaggcggtaccgcatgcgctgggtttcttctccggatctgaggttccgcaggcagagccacacgcgctcggtttcttctccggatctgaggttccgcaggcagagccgcacgcgctcggtttcttctccggatctgaggctccgcaggcagagccgcacgcgctcggtttcttctccggatccgacgcaccacaagcagagccacatgcgcttggtttcttttccggatctgtcgtcccgcaggcggtgccgtacgcgctgggtttcttttctggatctgaggttccgcaggcagagccgcacgcgctcggtttcttttccggatctgaggttccgcaggcagagccgcacgcgctcggtttcttctccggatctgtcgtcccgcaggcagagccgcacgcgctcggtttcttctccggatccgacgcaccacaagcagagccacatacgcttggtttcttttccggatctgtcgtcccgcaggcagtaccacacgctgtcggtttcttttccggatccgacgcaccacaagcagagccgcatgcacccggtttcttctccggatccgacgcaccgccgcatgccgttcccgcgccttccgctgcacgcatcatcccctgtgcgctcgtccttgcctgaaactctccgtttccgttccattcatccaggtttttcagtttgtccatcattttcatttccatatcagcttctccttttccactttacttccccaatttcagctgctgccctcattccccgcggcactgcgcagcatattcggccggcgctgcaggaacatatggcgcagttagtttcatgttctatatccatcatatacccggttttgctgcaaaaaaagtacgcacataaaagtgggatagtatctccaggcatattagtatccttctggtaaccatgcactttcttcagaattcaaaaaagcatcctccggtcaggaaaccggaagatgcctaatcgctttctatatcattttaataaaaaaatctttcagaaagaatccgccgcataccagaataccggcaacgggaaccagcccaccggagcctgcacatccatgaaccggccatattctgaaagcaggagctcctgcgcctgatgcttatcaagcaccgcagcccccggctttgccgcacgttccacagaaaccccattttcatccgcccataccgttacaggctgtccgtccaggaccgcagaaaattcacccaaagccagtcccagggttttctgtttcagggaaagataagcctccaggacattggcaaaatcaaaaatctgaaacatctcgctgggttccacgcaataagactctgcaaagcgtccgatacgctggttcagcgctttatcataggcagacgccacgatctcaatttcatcccgctctgtataagcaagatacgccttaatcacagcctccataattcccgcatccaaaagtcccagttcacacaccgtatcaccgttcccactgacaaggatatatccggttaacttttcgttgtccagcactgccagagccttttcccccatattccgcacaatggagccaatctgctccttcggcctctccacccgggcaggacgctgtttgttaatgttataaacaagctcgtatccgccctccgcttcctccagcgggcaaaaagaaatgccgccgcagtccgtcttcttcagtgcatgacgaatattagaacggtttaccgaatatttatactgcgaaccgccccgcgtaaacccaaaatattcatatcgctgcctctggccgcctaaaacggcaatgtcacaggtttcgcgcatttccttcagccattctcccatcagaaccttcatatggccttcgccccgcgccttcggatgtactgaaacggttcccacaaagcctgcctgcagcgctttgccgcccacttcaagctcttcccgcaaaaccgcaatcagggcgcggatttttcctctttcatccactgctatacggtgcatggaggcggaatcaacgccttctccataaaccctcggtatcaacgtttcgaaatcatgcggacagtgcgctttactgaaaacataatctgcaaattcaatacaggcttccctttcctcaggttttgcttttctgtattcgctcatcgtaagttccccctttttctattcctggatgtctgtctgaaaacatatgcagaatcagtgtatcctttcctgccgccaatgtcaatcatatgaaattctgtaatacctgggcccaaaattttgtaacgcttcagcaatgaatttccggctaaagttcatacagagcagaccatttagctgcgcaggccagcgcttcgcactgaccgcagggctatttcgccttcaattccgtgatttcctccgcatttcccgttatgccccctgccatgttattatccatttccgcggcattctgttcccacagcttctgcatcatctccatgattttttcgtttgcatccagggaaatccccagtacggcccggtcatatcgggaaaacgtgatggaagcacgttccccgctgacgccatatacatcaatagtaatggtcggatcgttagagctgtagccctggcagttatagacgcattccttcaccgcaccgccgaccagattctttttttccgcaaactcctttgccagcttcatgtattcacctggatcctttgccagcgccgcatccagccccaaatccacttttacgctcagagtcctgccatacgttgccaaaaagccttcccccgttaccgcatctatcataaaggtatagcagttatcctcaggcctccggtttgtgccgaacctcacatcaccgctccagaacgccctggggaaggtttccgttccattatcatagcccatataaaccgtggctccgtccagcctgacctcaaacagcctccataaaagctgtgcaccgatttccgccgcttcctcctgggtcagatcattttccgtgggctttttatcccgataatattccagcggatccgaaactgccgtatagctggctttgctgtagccctccggcgctgtctggccctgcgccgcagccggaaggttatatacggtgggaatccgctccgtccttcccatatcggcagccgctgccgcctccgccatgccgctgaacatggccgcacaaccgcatacaagggcaaaagcgcctgtcacggcggccagaatgcctgctcccttattttttctcatttttctttccatcctgtttttcccaacttttctgttctctctcattttcttttcctgcctttcttttttacggcgatacacttttcataaattgccctgcgccgtcttttgttttgataaggctactataataccgctatatgagagagttattgtaaacttattatcaagtgattaaatttccggaaaaataatccgtatgactgtcccttttcccggcgccgaaccaatctgaagctgcgcctgatgcacctgggcaatctgttcacagattgacaggcccaggcccgcaccgccctccttccggctgcgcgctttatccaccctgtaaaaaggctcttttatctgagagattgccttttccggaatcccccttccattatccgcgaccgcaagcgccgggtgccttccctgaaaatatgcgctcaccctgactgtcccgccgctgtcacaggccttgattccgttatctatcagattgatcagcaggctttccagcagatccctgttccccttcagctcctccagcttcgcttcaaaagaaaccgcaacgccgcgggactccgcctttggcagaatggtctgctttacggcgtaaaacagcttatccacctgaatttttcccaggcttcccccttcctcacgcagcgccgaaagctccagcagctgctgggagagattggataatctgcggcactgggacatgatatagcccgccgaggaaaccttatcctcctcagaaaccgccgccttctggagatattccgcataaccatatatggctgtcaaaggtgtgcgcagctcatgggcaaaattatccacaagcctctgcttctgtgaggccgcctcctccagctcggcaatctgcgtctttatcgtttccgccatctggttaaagctgtgcgccatggctgccacctcgtcccgccctttttccggaagcctgccgttaaagtccccggaagtcatctcccgggacgtctccgcaatctgctgcagcggatggaacaggcggttcagcagcgctatcaggcaaagggagagtaaaagcgaaaacacaccgccgcataaaaaaagcagatttttcatttctctccagttctcataaatatccttaaggctgtatttataaatgagggaatagtcctcatagggctggggaaaacacccttccacatagaggaagccgtattccccggtttcttttttttccttcaccatccgtatttcccgctggccgctctccttcaggctgggcgccagcgcattctccgcatccttccctgtccgctttgtttcatcggaatacagcagctggccgccatgatacagataaagcgacctgtgcccgtcctgcctgaactgtgtatagggctgcatcagctcctccatattatagttcccgccgtttcccctgctgtccagcgcctgcatgtccctggccgcggaggtgagaatcatataatgctccgacagcgccatttccttctgtacatccagtttttcatgccagaaaaccaccgccagaaaaaggaaagcgccgttgaagaaaagaagaaataaaagcatggttgtaaaaaaggtcttttttttcatattatttaatctccagccggtaacccagcttatatacggttttgatgcagtcctccagccccagctttttgcgcagcttctggatatggacgtccacggtcctgatatccccttcatagtcatagccccagaccaaatccaggagccgctcccgggacagggcgatattgcggttcttcaccagggtttccaacagctcatactctctgggcgtgcactctgtctcctgcccgtccttttcaatggtccggctttcaaaatcaatccgcacaccgtaaaaaacaaaatccgtcccgcttttccttgtccggcgcagcacagcctccaccctggccaaaagctccagcatttcaaagggcttgacaatatagtcatccgcccccatgcggagccctctcactctgtcggaaagcccgccctttgccgtgagaaaaatcgtaggtacatgctccgcggtctgatacacctcaaagccgtccgcccccggcagcataatatccagtagcatcagatcaaactgcccctcctgaagccgccggattgcttcctccccgtcatatacagacacacagcggtgccccacaagctccaggtttctcctgataagctcgttgattgccgtttcatcctccacgattaaaatatctgccataatccttctcttttcccttttttctttataaccgtagtttaagccaaagttattatagagttgttaaaacctggctgtctgaaccgttacctgcattcttccggagccactatactaaacggacatgtctgccaggcagacatcatcatgaatgaaagtcgattgctccgtgctacgaactcccacactcaccaccgactttcacagtaaaaaaagagacggcacccaggttggacagccgctgtttccccctgattggataccgcctcaaattattgattgccatttactgcgtatagcccggtgacaatccggattctagttttaacgaatacaaagtttactatttctttatatggcagaaattccacctaaaaacagattactgcaaaggatccgaactggattttcttttcagttcctctatgcacctaagggcttccgcatattttgctttttctctttccaactcttcttcatgccgttttctttctgcttccagttttttctcatttgcctcaagcgcagctgcctgcgcgtcaatcgtctcctgcatctcgtcaatcatatactgcactgtattacgatccagttcccgcaattcctttgaaaacatacccatcaccttttccatattccggcagagttcataaatatcatcatacatctccctgaacatcgggtatttatctatcagttcaattatccgttccggatcctcggaactgaaaaacattaaccacgcatccagttcattctctatgcttttattttccatgtttttacgaaaaatgtcaagcgtaatgaagataaagttctgcagaagctcaacttccagacctgtatcaaagccccagtaggatttatgcaggtgttttcccaaaacagcatgaaattctcttgcgcttttgtcaaacaaaacgattatgtatacatttttgatatccttatagctgaacttctgctttgtcctgtttttctcatcccgtacccttttgtactgcctcagcagcaaatccgcggaataacaggcgctgcgttctccgggaaaggaatagcctattttctggatttccacgtttgccaggcttccttcttcaaactccaccacaatatccgtgatcagcagcgtattctcatcggcaatcctgctgccgtcgttgggaatcacctgccggatcgttacctttttcccaatcagcagcgacagaaaccggttcagcctgccaggcgtatattccgggttcatgacctctttaaaaaaagaatcatagaggatcttaacccccttcatccctgtacagaaatcaaggaattcctcctgctgctccggcttccagcccgtgaataccgcatacagtccgctgttttcgccaatctccttcaacacctcctttcgttccctgatgagcgggaaataattcctgagcctatttgccataaatgctcctcctgtcttcaattgttgtcatttacggatttttgcttcgaaaagaagcgccgaaatgaaagaccggcctgaacggcctgttattacagcagcgtagatactgctgtgtgacggaattataataacatatctttttaaacatggcaatacaaaaagtccgtattctcattccgttaccagaatcaaaatacggacctttacgtttactttccagtatcctgaattacatcaccgtctccatctgcgcgcacatcagcaggaaggcgccaactccatgcagatcgtttactgaagtggggcgctcgcaataatgcctgtaatcccccacgccggttccaatgcacacgccgcccaccaggagatcctctccctcccaggccagagaatggataaccgcttcataccctttgacggcctgttccaggtactgctccggcaaaatccccttatgcaccgcttttacaatggcggccgtatacagacaggagcatgaggtttccagccagttgccctcttttccgcctttatccactacctgataccagcggccgtctgcagactgataacggcagacagactccagcagattacgcaccagggcacacagcttttcatactgtgggtgggaaggctccataaaatccagttcgtccagaatggcaaccggcacccagcctatgcttctcccccagaattcatgagacagccctgtttcctgatccgcccagtcctcacgatgggaacagtcccatgcatgataccacaggccggtcttgtcatcccttgttttttcctccatgagaagcgcctgcttcgcagcaagttccagatattccggctgctggaacctggcggcatattccgcacaaatcggtccggccatatacaggccgtccagccacatctgctccggacatccttccttatgccagaatccgccgtccttgtttctgggaaaatcccttatgataggaagcaaggtatccagcgccttctgatacctttgatctcctgttttatccaacagcggatacagcagaatccccggctggatatcatccagctgccccttgtcaaaggtatgtatttccccattctcatcgataatggaatccacccagtctttgatatactgaaaatacctctcatcgccacaaagcctgtatgtctgatatacccctgaaaggaaaacaccctggtgataatggaaatgtcctttgggcggcagatcctgcgccgcgaatttccgcatcatcgtttcgcaggatgctttggcataatcaattggtttcctgttctgattcatctgatttcctcccgattgccccgttttggtacaaaataatacataacatattatacacgttccggctttttccagtgatacacatctccctgacagccgtgcagtacaatttcttcttccttataatcaaacacggaccagtatacgctccggctgttccacacacaggcttcggccgaaaacaggctttcatcaacaggcagcggcatggcggcttcccggttatcctttatcatatacgcctcaaagccctgcctgaaattctgattgaaaaccacacccctgtccgtcgccacaaaccgcgccgccctgcagtaaatggaatccggcgtcagttcaaatatatacatatgtttttccgtattgattgtaacgcccataaatgtgggtattcctctgtaatcaaaaaattcctcgcggatccccatattccacagccgcagacattccccgatattgccatcgcaaagctccggcagagccggccgcaggctttcatccgtaaatttttcttccaatactgccggataaaccgttccgtcttcaaaccgtatttcaatctgaccgctgccataaatcagggggagtggactgccaatatacccctttatctgctcatcctcttctttcagataaacaggcggcctgtccattctgctttcctgccctttctgatatctgctgcataccgcaaggatttcatcctgataaacaaaggcggtacgccagcaggcaggcggcctgtattgctctgtttccaaaggcgcggactgacagattccgatacaggaaaacccttcatccgtccttctgaacagtctcgcttccagattatctgacggtatattcctgcggaatgtaataacatacttctgcgtaactgccatttcaaaatccgttcctatataaactccggaatctatcataatatacgcccctcacattctcatatatgcgcccctttatttttccaatgaaaatgcaataaaatcaaagctgccttccccatcatagcggaaatacaaatcctgctcgccgtccggcatatttacttcgccggaagcctcctgccaggaatccgaatccacatccacgcggattgttccagccgcttttccttccgcttcagcagaaacggtcacggttcccttaccgcagcctctaacaagcatggtaatcttttttgtcccgttaaaacaaaacgatttatacccgattactgtgccgtcgccaacattggctatatactggacgggaagcccttcctccgtattcacgccttccgcatcaggatccctgtccgggatatcctgggtaagataagggaacctgaattccatatccccctgggaagaaaatacagccccgtcctttccggtcagcctgcagcagatataagcgggatatttcccttctccggccagcgggccatcattcaaaccgcatgaggtcaccggcacctgcctgatatgcccgtccgcatctatgctgattttttccgcgcagccctgtctggaaaactgggtgcggttggtctgcctgtgatagaaaacataccactgcccgttaatgtattcaatgccgccatgggtatttcccagacagttcagggcatccttggcacatcttccctcaagtcccacatctccgatatctatgattgtcccgccataaatataatcccggtcaggcctgctgctgaccgcatagcacaattcgtggctgaggacagaggaatatacaaaataataggtgcttccgattttacggatggagctggcctcgaaaaactcatggcccacaaagcttgtcccctcactgtccgcaatggagggcagaagcaggcggggctccgttttcagggtaaccatatccttttccagcgtcatcacctgggagccctgcttccctccgatatgctccttatgcatgggcgcgttgccggaatacagatagatttccccatcatcatctatgaaaataccgggatcaaactgtcccagatcattctcccctcttcccagtatagtaccgtccgcatgcttcacaaagcccaggaattcatagcttcccgcaggcgtatcgcaaaccgcaacgccgatttccggaaggaaatccagacaataatataaataatattttccatccagccccttcaccacgtccggcgcccagagagcatggattccgggaggattcagaccatttccaaacctggacttcacgttgtaaattttacggattggctccgtttccgtagggttctggtttctggggtcctgatcctttctgaaaataacgccttcatacttccactgcgtcaaatccttcacatccgccgaatagcagatataatcgttcaggcagaacatttcaccgtcaaaacggtcatggcttccgtaaacataaacacggccgccgaatacatgcggctccccatccggtatgtattcgtaggatggcaaataggggttataaacctgtttctttgtcattgctttctcctcctgtgattaaagggcagtaactatacagtccctgcacagttactgcccttccatattatatcacatccgccagctttatacataccccttatccgaccagttatgggattttatccgatcatattcctccatggaaatggtcagtatcgttccatgcttaaagccataagggaaatcaaaggaagcgtccgagcgcacaaaatgtccgtccgccaggctgtccgccacaaaggggacatacccctgtcccgcgccgggaacgccgtaatagtccaggaacaggcaccaccggccatcctccagcttcaccgcggtaggcgcttcgtacaggccgctttccacagcttccatgctttcgtcaaaggcctccacacgctcgtaaggccccgctgcatgggcggaccgcagaaggatgatcttctccgggtttccttcactcttgacaaacatataataccagccgttttcctcataaatcgcggagtcgatcacgccgctgtcctctttccggtataaaacctcaggagcgctgaattccttaaaatccttcgtacggctgtaataaatccctttccttccataatcattgcagctgtgggaggacgaccagtgcagcagataatccccgttttccctgtcataaatgatatccggcgcccacaggcagccgaaattctcatccccgatttttgccagccgctgctccgtccagtccaccagattgtccgattcccatacggaaaagcatttgctgccgttccttccgatttcgtcccaggaaccatgatactggtttctcataccataggaaaggcttaagtccgtggcaaaaatataaaatttcccattcccttcacaccgggtaatcgtgaaatccctcacgcccttgtccccgtaataggtccagagcaccgggtttccgccgttcacctcttcccagtggaatccgtccttactcaggccgaaatacacctgctccccgtctggggtcgtcttttctttgaaatgtacaaacaagtatgcctgcatttcatttctccttccgtctgaaaactgtcagtaattttctgaggaactcctatacaaatatgcagccttccctatcttttgcatgtgatttatccccggcaaaaggataacctccacaaggctgtttaccggatatttccccagaaatatattctaacatgaattacaggccggaaaaagaggaagcatgcatactgcagcattcttttttgcagtcatactgcgccattcttttcccactttatttcttatccccgtttgctcccttacccacgccattaccgatcaatctgcgcttccattttatctccgggataagcaccgccgaaaggatcatccccgctcccgccaacatgcgcaatgttatatgctcctttaaaagcaatacggaaaacaggcagccaaataccgcttccagagatagtatgaccgccgcctttgtttcatccacatacctctgggaaagggtctgtagcagataagtaagcgctgtgctcaccgcacccagatataaaaccgacaataccccgccggcagtaaagcttaccttcacattccggctgcataccagcccggccagagaacatatgcaggccgtcgccatctgtacaaaattaagcgccatggggcgatacttctccaccgcttttcccgtcagcacaatctgaaaagcaaagcagaccgcgccggccagggtaagcgcatccccaagccccagccgcagatcccgttccagggacagaaagccaacgccggccagcgccagaatcgcaccgcatatttcggccggccgcaccttttttctgtaaaaaaggaacgctataaaggggacaaaaaccacatttgccgcggtaagaaaggcatttttagagggtgtggtataacgcagccccaccgtctgaagggcgaaggcggcaaacagaaacactcccatccctgttcccgccttccactcctgcctggtgattttcgtaacccggggaaaaccggcggcgcccataagaagcgccgccagaagaaatcttcctgccataatctgaaaaggttccaggctttgtaacgcaatatcgctggcggtaaatcccgcgccccagataattgtgacaagcagcagtcccagcattccccagtattccttcacgttttactcctctcccagatccggatattcccacagcagctgcaggagaacgcaggagggccaggaaaaagccggatcgtcatagccatccccggtaaagggatcataattttcactcatcagcccgatttgcgtgacacggcagaatttctccgccagcctgcgcgcctcctgctcatagccgttgtcccgcagcgcatctatcatcagatacataaccggcgcccagacaggccccagccagtatccgcccgttttgtaatattcactccgggggttttctgttgccagcccgtacggcgtctcaaaccgctccagcatctgacgcaccagttcatccgccgttttcttttccatccgataggcaatctgcagcggcatatacattaacagactgtcaccttccataatctgctgccgttcaggcgtataccatgcgcacaatctgccgtttataaaaaatcgttcgaaaaagcgcccatacatttcatccgcttttttcttccatgccgcactttcctccggtctgtgaagctcctgcgccatacgggaaagcacatccatctgatagataagaaatgcgctcaaatccggggattccacagggaaaccccgatggaaaacagaagcgttgtcccagcctgaatcatttccgtgaaaataaaccggcatcacggctcccggcgtcctgcggcagcaaagccagtaatccgtaacgcggcagaagctttcataggcctcctcctgaatttccttctgtaaaaagaaagcattctgagcgctcattttctgaaatgcccaggcatggataggaggcttggtacagttaaaggaagcgcccgcctcatttatgtagtccgcatatacgccgcagctgtcctgattgtccataaaaatcttcaactgtccccatgccagctttggctgcacacggctcagtgcaatccctccaaagcagttatcccagctccagatattaaacatccagttctttgacatatacatggcgtcgtgggtgaggaacccatttgccgggacgaaattggcccaggtaagataagcggccagcctgcggctctcctcaaaaaccctgtttggtccgcgaaactgccgttcccaggcatcgaaggcttcctttgtttccttatgggcttcctcataggaaggatattcctgctttgttcccacacaccggtagctttccaggacgcagtgtgtccgcagcggcgctccctctgcatttttcccgcagacagagataaccgcatccctgctccccaccacatcccactgctgtgtctgcgttatccgcccttgcagacaggtaaaaagaaacttccgctgttttttataaaaatgatgttccatccgcctttcgtccaggggcacaagcgtatcatatctgcctcctctggcatgcagttcaagcaccaggccatccgccaggaaatggacgcggccatccctgtccatgcagattttcagccagcattccgcctgtccttcccgaaaccacataagctcagattccgtacggataaaacgctgcctctccccgatttccgggaaccgcatttcataaatatcggagcaggtttcatctccgccatgcaagtcccgcagatacaggcagccatcctcctgattgatcgaaacggcaaaataagagccatacctgctgaaaggaattttttccaatccgtattccatacccttctccttttctttgaaaacagccggccatctctggccggccggaattgttctcccgctctacttaatggagccgctggttccttctataatatatttctgcgccccgataaatgctaaaatagggggaattatcatgataatcgtgatgcaaagcatggggacaatctgcgtattatgcacgcccttaaaggaggccagccccaacgccagcgtaaacttgctgcgatcctgcaggaaaatcaatggccccaggtaatcgttccataccgtcagcagattcaggaccgccaccaggataagctgcggcctgagaatcggcatgaaaatcctggaatagatctggaacgcattggccccgtcaatccgcgccgcttcctcataatccttaggaacccccatcaaaaactgccgcatcaggaaaatataataagccgagccaaaccatgacggcacaatcagcggtttcagcgtattgatccatccgaacagcttgaattccatatactgcggaatcatcgtcacgtcccagggaatcatcattgtggaaagaagtatcatgaacagcacatttttacccttgaactcatatctggcaaacccataggcaaccagggagcaggacaaaagctgacccacagtcgttccgatggttaccaatatggaatttttcaaaaatgtaccgaattcctgagactgccatgcatttacaaagttgctccacaaaaatttcttcggaaacagggacggcggtattgcattgatctccgcttccgttttaaatgcggagaaaaacatatatacaaaaggaaaaaggaagtatactgccacaagaatcagcagtgcgtaaatcacggctttcgtacctttattcagtttcatatcttctccgatctgcgcgccggagcgcacgttttatttaagatcagccttttttctttttgccgcccgcttcagattcatagaacacccaggcgtcggaagacttaaacacaacagaggtcagtaccaatatgatgaggaacatcacccaggcgttggatgccgcatatccaagcctgtgatgcttaaaggcgttatcatatacaaacataccgtaaaaataggtcgattttaatggtcctccccctgtcagcagcataacaagcgtcagctgctggaaagcgcttatcatggaggtaatcaggttaaacagaatcgtgggcgtaataataggtatcgtaatgctgaaaaactgtttcacaggccccgcgccgtccaggctggccgcttcatacagatccacagggatatttttaatattggtgtagaatatcagcatcatcgtccccacgccgaaggcgcttaccagaattaccgcgaagagcgcccatgccggatccaccagccagtccggcccgtcgattcccagcagggaaagcaggtaattgataatcccgtactctccgttgaacatccatccccagataatggaaatcgcaacaccggacaccaccgtaggtatgtaaaatatggtccggaaggtctttaccccctttaccggctgtgtgataagcattgccaggaaaagggcgattatcatattcagagggacaaaaattgctgcatatttcagtgtgattatcagagatttgccaaattgccggtcctgggtaaacatttccaaataattgctgatgccgcagaatttcggcgagcttgtgatcggccagtcaaaaaagctcatcacgaaggaaagaatcagcggccccgccgtaaataccagaagccctgctatccatggcaggataaataaatagggcgttgcttttgttatccactttttattcataatttttgtccccctgacatcctgttactgctcggcgaccactgcgtccagcacggtttgaggatcctccagtgtattcgggttaaaaatctcttcaaaagataaagaaagttcatcggaaatataggaccatttatctgtcaggaaaatagtaggggtatatcccacgctctgctccagcatcttataaaaaggcgcataaacgggatcctccataattttctcagattccactacggacttatgaggagacatttcatatccgagacgttttttattcagctccacgccggtccagtacttgatgaattcccaggcagcctctttgtttttggaatccttgctcatggcaaggcccgatgtgctcaggttgctgacggaatcatggccgcttcccgcaaaagccggaatttccacaacgccataattcagaccggcttcattaaaggcattgatagaccatgcgccgtaaataaacattgcggatttctgagcgctgaattcattgcgtccgcctttttccccggcaagcgcgtagccgtccttctgcatatcctggaacatcgtaaacgttgccacagactcaggggaattcagataaccgtccatctttccatctttgcctacatagcttgtattattgctccacagatacatttcataatcgtaggcatctgccttgattccataagagaagccgtaaatgccaagcttttcatgaatctgttttgccgccgcttccaggtcatcccaggtccagtctgaggtcggataagccacccccgcctgatcgaacagatccttgttataaaagaggcagtgcgtggtaaagcctaccgggataccgtaaatcttgccgtccatgctattgtaattccacagcgtttcataaaaatccgctttaaaatcctcgccttcctttgcaagataatcatccagaggctccaggccttcataataatccggataattccacatatacatcacatccggcgcatctcccgaacccatgcctgctgcaattttggtatcaaaatcactgccgtaggcttccaggaccacctcaatatcatcatgctgctcattaaaagcatccaccagcttctgctgatcctccagatcctccgcgctgtcccaggaagcgaagcggattttcaccttaccgccttttccggcctcctcctgcccggtccctgcgctttttccgcagcccgtaagcaccatggataccataaatacaaccgccaaacccaatgccattatttttttcatgctttctcccatctgcgcgttcccgcgcgccaataaaaactatatgttacttttactgcatgttttgttttttcacatcatcctttccctcagacctgcttttttctttgtatgatggtaaactgccacgctcagcagaaatctcgatatctgatccagcgctatgataagccatatgctgagaatgctccatttcagcacataagccgcgatgatgctgagaggtatcctcacaatccagattccaaagcccgcaatatacatgggcactcccgggtacccggacgccctgatggtgccattataaatacgggacagattctgcggaatctgtacaaatcccataataaatacatagaccgccccgatggcctgcagcttggggttattggtcatcagtcccataaaagccttcggcagcacgatcagcagcagcgaagtacagatgctgatccgaagagctatcctgattaactggttaaaataggtttcctttaattcataatccttctgtcccagcgcgcgtgccgccagcgttgtggaggcagtgctgaagccgatggcaggcatttccgtcacggtttccgcctgtatgcccagctggtaggctgcaaatgaattctcaccgtaagcaaggattaccttactcagaatgattgcggaaaactgccagaacatgctttcaagcgccgccggtactcctgtcctgtatatctctttgattaaacggccgtcaggccgcaaatgatgcttttgctcttccgtattccgcagcaggccgccttttctgtatagcagatacagaccgatgcaggcgcctcccgcctgggatgacaccagcgccatggccgcccccctgattccgaattccggcagcaggcccgggccgaatatgagaagataaccgaaaatgatattgataatatttaccgccaccgctatgtacataggcgtcctggtgttcccatgcccctgaaaggttgccgtcaccaccgacatgataaccacaaacgggaacccgaatacaatgattctcatgtattctcccgccttaaccaggattcccgcatcctccgtaaaaaaacggaagacaggcattcccacaaaaaacagcgccacacctaaaagcaaagcgatggggatttctgtcagcagcgtctgttccgccactctcctgcatttatcacgttttccggccccgaagcttctggcgatcagaaccgtggctcctatggcaacgcctttgtagaaacaccacagggtatccgtaattcgcacgcatattccctgggctgagatatcggatgccatcagccgccctatcattgccgtagaaataagtcccgccgatacctgaaggagattttccaaaatcatgggtataatcaggcggtagatttctttcctgaccgttttttcattcccgtccttttccgccgggcttcctctgcttcttccttccctgttattattcattacttttcaccgccctgctttccgcaagcgctttccatgcgcctcgggcctgttcccagacactcccgcgcccggccgcccccaactgccatttcagatgaaaaggaagcggtcgcagcctgtactgaggaagcgcttccggcccccagcttgcgctgcccaaaccattctgcgcgtaatctgcctgaagatacaccttattttctctgtgaagttcgcaggtatgcgcagcacgggtcagctcctcctgggaataatgcaggatactgaaggaaaaagggctttcgcctgccagatacagggcgttgttatttccttcaaaaaccgcgaatctggtatcttccctgtttccgttttcctgaggcaccacgtaagggaaataaaaagcatcggcatccgcccggtaacggcccacccggttgccttccttacagtcgggataggtctcaagaggccctctaccgtaccactgcgcattttcacatgggtcattgagcagaaaccgcagcccgatgcgcggcaggcattccggcagcattcccaccgggttcccatttacctcaatcgtcactttgccttcgctgtcaatggtgtacgtgctgtcaagcaggattttccattccatgacaatgggcgcataggtctgtctgcaacggatcaccgccttcttttcgtcccagtccgcttctatcgtctccaccacattacacatacagtccgcccggtaatcttcccacattttctccatatttttgtcgttatccaccggcgccctccaaaaattgaagcccaatcccctgcagagcagcttttctccccggaaggtatatccgtccagccatccgtgaatacagtcaaattccaggctgaaatccctgccctgtaaatacagccggccatttttcatttcccccgaaagcgttccctgcgtactttcctgtacttttgtcacggcgcttaaatctgccgccatgtcctttggcaggatattatccacttcggcagcctgcaccagccgttcctgatggacggccgcctccaaaggcccgcttccctgataccaccggggattttccctgtaaataaagcgcagacagatccaggcctccggcaagccgtccccaccaggaatctcacctttctcaaacagttttatttcctgttcagactgcggtgcaatcccgtcgattggcacttccttttcccatctgacgctgccgcaggattccagggtgcagatgcattttaaatgggaaagcgtctgaaaatcatatcggttccgtatggatatcgtgccctttccggctgaaaacccgaagcatctgaccggctccagcgcttttttcacctgactcaaagcaggcgtgggccgtctgtcggcctgcactaaaccatcgcagcaaaatgcgccgctgttgggatagtccccgtaatctcccccatacgtaaaatacgtaactcctttatcatccctgcgttttaatccgtgatccacccattcccatataaaaccgccctgcagccgctcatatttatcgaaaatttcccaatattcctttaacccgccggggccgtttcccatggcatgcgcatattcgcagacgatatgcggttttcttttgctcgtatccctccccagccgttccagctcctgatggctcgtatacattgtgctgtacatatcggcgatggaagcatccctgtcctcttcataatgaatcagccgggacggatcatattccttcacgaaccttcctgccgtcacaaaattgctgccaaagccggactcatttcccagcgaccagacaaggacacaggggtggtttttatccctgcgcaccatgcgctccacacgatccaggtagcttgcttcccacagcacatcctcgctgagacggttcattttccctttaatataggtcatctggttgcactccagatccgcctcctccatcacataaaagcccatacggtcgcataaggacaggaaatccggatggggcggataatgggaggtgcggatggcattgatgttgttttccttcatcaataccagatctctgtgcatatcctccagggttatgcagcgcccactgctttcattccagtcatggcggttgacccccttgaatttcacaggcttcccgttaacaagcatcctcccgtttttcagctccacccgcctgaagccgacctcttccgcatatacttctacaatgcgatcctcctgcgcatcctttaaaaccatttccatacggtagagaaagggctgttccgccgaccactgtctgatctcttctattttttcctccagcttaagctcccgtttctcccccggcgctgcacacagcttaagctccctgcataggaccgccgtctcttcccggaaaaggcggatcgcaagaatcagctctttttcctttccatctccattttccacacaaaaagaagcgttcaggattcccttttccccatcctccgtcagtccgcagtccagctgataatcggccagatggacacggggcctggcaagcagcgccacatccctgataatccccgaaaaccaccacatatcctgattttccagatagctgccctcacagaatttatagacctttaccgccagcagattttccccgctgcgaaggcagtccgtcacatcaaattccgcacttaagcgcgatccctggctgtatcccacaaatgtgccgttcagccatacatggtaagcgctttccaccccgtcaaagcggagcagatattctttctcctcatccttttccacccggaaaaaatggcggtaagcgcctgtcggattgtcgttctgaaccgcgggcctttccaaaatggggaaaagtgagatcgcatcgttgtagtggggatacccgaagccgtttaactgccaatgaccgggcacaggcatcttgccccacccgctgctgtcaaactccggcttcatgaaatcctccggcgtctctaacggattttcataatatgtaaaatcccagctgccattcagcagcttataattgccgctcttttccctgtgcatggccgcggcgctttccctgtctgcatatcctgtataaaacggccttgtgcaaagcctgtttctctgaaggacttcgatgttgttccagtcctgtaactcataattaaatactgctttcatgctgactccccgcatccgctttggcggatttaaatctgttttttcatctgttgtttcacaaaatcattcccgcgcacagctctgccggagaatgagcttattgggtatgacggcccggattcctctgaccctgccggtacgcatctgctccaccagcagctcggccgacatgcttccgatcaaatccccatagatatgcactgtggaaagcgccggggaaatgaactctacggttgggacatcattgcagctgataacggaaagctcctccggcacccggatgccgttttcctcaaacgcccttaagcatcccatggccatagcgtcattttctataaaaagcgccctgggaagatctccgttctcaatcatctggcagcataaacggtacgcgttctgtgcatagttgatatctgttttccagacgaattcctccctgtaaagtccctgttcctcaagtatctgtttaaaataaaggaaacgtttatcctccaccgcccggccgcttaccgccacgccgtaggtgcctacatagcctattgttgtataagaaagacggaagaaatgggacagcgccttttccacaagagagtggaaatcattgactacacagtccgcttccacctccatatcttccgggtcaaaatcggcaaaaaccacagggattcccgaggctatcacgctctgccggatcttttcattccgataccagccgcctgcatggcctatcagtatcgtacctgaaaacctgctcatatcaagctccttgccctctttggccgggcagaaaaattctcttaccctgcagcccttttctattaaagcatcctttaccgtcacacgaatcagctgataataggaatccataatctcgtcatattcgctgtaaagaagcaccaacgccaccgtcgcctttccccttgccgcctcttcctccgcgttcgttccggtgcccttatagccaagctcttccgctgtctcccagatttttttcttcgtactttcagaaatcgaaaagctgtcgtcccggttcaatactctggatacggaggtaatggatacccctgccttagttgcgatatctttcagtgtgggcatatgctctcccctttcagttttactaaaatttacttccttctatatttctgattatatgcaattgtttttctcttgtctacacttcttttcatatttatgtgctatatgtatatttttgtatggattgcataattaaattatgtgtattttgttcgctttttactttaattttgtggcataatggccatttattttactaaaatttttactaaattttactttgcttttttcacattgcaggaatcatttttatagttaggttaatttccagaatagactttgagttcagcagaaatgaagctttccttttcacataaaaaatccgggagtcctctgttttcgttggagaactcccgatccgtatgcttgatacaagccttttgtttacatctcttttaacctgtaattggcctttcctgagaaaggccccccatctcatcttaaacattctgtccggaatctctgaatcccggcaatcgctttagatcaccttaattccgggacaatgcatttttatatatggaacaaatgcatctatctgccgttgatccataccctctttaaaggtgacagcaaattgaattttggtgaacagggaaaaatatttttctgttatcaccagtttcttcaaatgagcatagcccagaatagccaaagcgccggtggagtgatgattcccatacatccgctcattcctactgttcattgaccacctgtgcaaattccgtgagaaattttttaaaattgtcaacctcttctttctgttcgatttccgaggccgccgccaggggaagcgatacgataaactgcgtgccgccctgcagataaaatattgtacggcctgaggctttcagcttaaccttttccaccgtctggcgggtcagatgcaggatgcactccgtatccgcctcgatcgtattatagctgggattacccacgcacactgcaaaaatttcatcgccccggtaagccagaacgaatttgggcgggtgactgccataggtatgtaagtttgcccgcactccaaaaaccgctcccacagcggctacggcgaattgtctggcgaaatccccgcccgcctccttcagtaaggacatggtgtccttttccgcctgcgccatgaccacagggtatcctttggcctggggtacggcttcttccacagccctgtgcattgccttaaaaagcgccggcttcttctttgcccgctttgagttaagctttgccctcaaaagcagcataagaagcaacacaactaaaataccgccgaacataataagaattccgcttgcctgactcatcttccattctccctcttcctgtgtacgccgcaaaggtttccacattatttcatttcactgcctgtacattgccccggagcagccgcagctgatttaacagcaagactatggactccgccggttttgcctggcatttatcttttattatacaggaggcgcctgccgcgccaaactccaattcattacgataacaataccttttcatgacatacacgttggagactgtctgtctattccgtatagaagaccgttgccacagcttctttgtctgcgtgcaatcggcaggtgtggctgtattctgtttttcgggggaactttcctttcatgcaaaaaaatagcggaaatgttctgataaacatttccgctaaccatattcaagtagcgagagggggacttgaaccctcgacaccacgggtatgaaccgtgtgctctagccagctgagctatctcgccagattatatgggacctatagggctcgaacctatgaccctctgcttgtaaggcagatgctctcccagctgagctaagatcccataatcaaacaagtttctgaggcgctttgtttaccgcactcgcaacctgcttgattagtatacaaaaaatgggacaacttgtcaacacatttttttaaatttttttacaactttttatcacttttttccgaactcttttttccatttatacgaatcttatctatggcctgattttcatttccagacccgctatatgtgtatgcaaactgcatcaaaatacggagctagaaagcctttttgtttacttgtaacagcttctgccggtacatacattaaacttaacataagaaaataaactaaaagggcaaaaattttttttagcaatcataaataaattctctccaaaaaccggtccagccaaatattctattcaaccacaggcagaattcggctcacttggtaagctattgttctgttttcatacttcagttatacttatcacaagaagaacgttctttgactaaaagaaaagaggaaacttatgaagctatctatcggaaataaaataaaagctttacgccgtgaacggggaattactcaggaacagcttgcagaaagtatcggtatatccttccaggcggtaagcaagtgggaaaatgatatctcccttcccgatatcaccctggttcccgcccttgcaagctacttcaacatctccattgatgaactctttgactttaatttaaaggaaatccaggaaaaaacagaggaaatatgccgggaagcatataaatacaggaaaaccgatcccgaaaaaagccgtaagattcttgaggaaggcctgcataaatatcctgacaatgatattctgctgaataatcttctttatgttatgaattattccgacaatccggatgaaaccatttccgtagccggaaaactgactgaacagaccgatgaccctgctgtaaaatatgatgccctccgtttccttgcctatgcttttcatgcaaaaggagaccgcaacagcgctttagcggccattgatcagctgcccgaaatctattttactaagctgacagaaatggcatctctacagacaggtaaatccaaactggaagcagcagaaaaacaaaaatggatttcttttgaaaatctgctgcaaatgatgataaaaatcgctgaatattacgaggaaacgggtaatattacagctgcattatccgaaataaaccgggctcttttgcttctatccgcaatgaaagaagaagaaaaaattgaaaaatttaagatttgagactgtctatataactgtgtattgtagtaaattggtatgtacccggtttccttttcgacactccccagtttggttttacctatgtttgcatgacagtttttttcaaaatacgacgtttgtttatatgaatagtattgccgctttccggcaatactattctagttttccctttattttttcttcatttattatggcatcattggaaccaaatacgatattttgctgatagatcttttcgatctccctttcattgtaaaatccaaataacatttcaaggatcacctcgaactgttcctccgtcaacggctctctatcatactccataactcgatatgctacacatgcatatgctgttgctgcatcatgtgtcataatcccacgctcctttcacaccatccttttattgatagttattaccgtagctgcaggctttattcaataacgatcctgaacaaagcctgcagctgcggtactatacgttaacaaaagaatattggatgggacggctccctgcacaagcctctcgggaagatcgcgcgttctctcaggcgatggttgccctgtcgccgaattcgatgataaactgtccgtaagtctcgccccaatcccgatagggcatggaccacttttctgttatatcccgcgttgtcagatacaacgttttccttagtgcatcgtcattaggaaaaacggctttattttttgtcactttccgcagctgccggttaaatccctccagggtattcgttgtatagatgaggcggcgtatctgtggcccatagctgaaataggtggagaggttttcccatttcatctgccagttctcaacgaccgcacgatacttcttccagctgtccttcatcgcctccaggttcatgaatgcgatctcctcactttcggccccgtatacccgtttcagatccttcataaatgccttggaatccttataggctatatatttcatggtgttccgtatttgatggataatgcatagctggatccttgtttcaggaaatacggttttgatcgcatcaggaaatccctgcaagccatcgatacaggcgatcaggatatctttcactccacggtttttcagttcattacataccttcagccagaatttggcaccttcattttcaccgatccagatccccaggatgtcttttcggccttccgcgttaatccccagagcgacataggatgccttcgtgacgatccgcccttcttcacggactttatagtgcacagcatccagaaatacaaccggataaaaaccatccagggtccggctgtaccactcccttgcttcctccatgattttatccgttatattagacacggaggccggggataattcaatcccgtaaagtgcctggacatgggaaacgatgtcacgaacagtcatccccttcgcatacatagagataatctgtgcttccagtccctcctcgatcacagccctctttttaataacttccggttcgaattccccttccctgactcttgggacatcaatgtcaatgctgccgtaagaagtctttacttttttaggtgatgttccattccgctgcggggtattccccttacttttttcatctgtgatataatctgtgatctcgctttgaaggatctgttcgatcgcatcctttaccattcgctggacaagtccgtttggccctgtgatatcctccatggtactgcacttggaaagttcctcctgataattaaatcctgatgtcatatcccttaacctcactaaatttatttaccaatttattccacttacatgcagtattgtcagtagtaatgatacctattcaaaaaagaggtgtgtcgaataatctgcacgtgatacacagtttatttgacacaccctaagatttacacagattatctgttcaaacagaatcaaaagctatgcgaaatattaccttcatcacaattgcagtaatcagatccattccatcgtgtaatatataaagaaaaatccgctctgccataaaacagaacggatttttccattttccatgaaaattttcataatggtcacgatctctgaattactgcttcatttcatcattccggcaaaatttatttccccacagccagcacctttgcctcaaatggcttcagctccatgcttccggaaaccgtttctcccgtgaacagatccacgcattcctttttcagttccacagcagcgcattcatccaggtaattcaaaacaaacagatacgtctgctccccttccctgaccgccagctcacagccctccggcaatacaactgtatctgcgtaaggctctgcaacacccagcttttccaagaaaatctccgccgtatgctcagaaaaagcgccgccaaaataatacacccttccttttccctgctccctgctgataagcgccggcgtccccgcgtaatagctggaagaaaacctggcctccaccttcgcatcctctgtcagcggcgcaagcagatcgttaaataccgccgcttcgatccgggtgccgtcccagtccgcataaacagttccgtccgccggggaaacaaaggtatattccggaatatccgtccctgtcagcggcgcaagcaggccgggcaatttactcatcacacattttcccgtctcatccttatacccggtgcggcagcccagcaccagacagccgccctgctccacatatgccgtcagcttatccgtcatctgctgtgtcagcatggttgcatgaggatagaacagaacctgatattttgacagctcctccgccttcatatgatccagatagcagaagtcaaagggcgtatgctttctctggcaagcctcaaaaagccctttgccgctttccctctccactcttccatgccaggcgtccactacgctgtcccacagattatcgtaatctcttacaagacccaccttcgcctgataacggcttccagccacacaggccatacgtcctgccttctcatggatttccttcagctcggaaagccgcctgttgtcccttcccgaataatccaggatgccgtgccagtaaatttccgtccccatagtgcaggtacgccaccggaaataactcacataatccgccccgtgggcaatactctgcatcgtccacagcgtcatctgccccggctttggcgtgggtgcttccatccggctgttccagccgtttgctcccgactgctgctccataatgccgaaattaggggaaatcgctctggcctccgccagattgcggctccactttctgtcccgcatgcttttatcgtccggctcataggaatccaggcaataagcaaaattcgggtaggagtcataggtgataaaatcaaggctttcctccgtcatacggtggttatccagattcccgaacagcccgtttgtggtaatgaaatccccgggctttacatattttttcagaatatcgctctgcattcttgcaaaacggcaggtactgtcagaaataaaacgtatataatccagcacctcatgaggattggtagaattactgggcgtcggccggggcacatagatttcctcccattccgtataggtctgattccagaaaacagtcccccaagcttcattcagccggtccaacgtaccatatttttcctgaaggaacacacggaaagccgccgtatcgctttcggaataaaactcattcacctcacagttaagctcattgtcaatctgccagccgatgatggcaggatgcgccgcataatgggcggcggatttctccacgatccgtttcaccagctcctgatatttcggagaattgtagttgtaatgcctccggcagccgtgacggtaaagcaccccgtcctgtctggcattgagcacctccgggtatctgttggtcagccatgccggcggcgtggcgcttggcgtacagaaaatgaccttcatgcccgcgcgttccgctatttccagaaaccggtcaaaaaattcataggtaaattccccttccctgggttcgattttactccaggcaaattccgccacacggaccacttcaatcccattctccagcatccgccgcagatcctcttcccacatgccctccggccaatgctccggataatagcaggtgcccagcgtgattttttccaggttcatactccgttccataatttctctccttccgcccccctggggctgcacattttatttttccagccgtccaatatctttacagctgcttaattcccttctttttaccgcatccgcccaaaataattacggcactttacggcactatctgatttttctcaccgaagcgccctttaccagctgtaccggcgagcctgacacatactttactttttttccctccagcatatccagcaggatatccgcacatttcgctccctgtttttccggaaacaggcccaccgaggtgagcagcggatccatatacttcctggcggagcttccatcgatccctatgatagaaatatcctccggcacccgcagccccatggaatgaaaggccttgcacattcccagcgcaaattcatcgttaaaagccaccactgccgtggcatccagccttctttccgcaaacagccttgccgccagctcccctttcccgaaaaaatcctcctccatcagctgcatgccgtcctcccgcctctcatcctccagaaaggataaaattctgctgtctcccgccatatcttccctgtagacgccgatataatactccttcagcctgtccccgtaaacttccttcatcagcgagcagaaggaaagcctcctggcatccatggagctgaaaggataaggcatgcccagcgcaatcctcctgtgcccgttttcacgcagcgcgcggaccgcaagctccatcaccctgaccatatcgatttccacccgtggcaccgccctggaaaagccctccgcatttccgtaagaagcgctcaccaccggaagacggtaattcctccccactgtatccaggtaatgctgggtaatgccttcattgggcatgataattccgtcaatcatggcattcctgattttctcaaaatccatgctgccgttgaagaccaccatataatccctcttcccggccgcctccaccatccctctgtacatatctatgtaaaaagaattcttcagatccttgcagaaaaaaagaatctgcttcgtcctcctcttctgcagcgcctccgccacaggatggggatagtagccaagctcctccgctatggccagtattctttttttcttctccgcctccacgtatccgctgttgttcatcgccctggataccacggaaaccgatacgccggctctgagcgcaacctcttttctggtgaccattctctctccccttttcagcaataaggtttcaggctgttcctgccttccgccgtctttttctgcccggaacctgacaggatatgaggttattgtaacatatgggggtatgattgtatcttagcttttatgaaaaaaggttgcaatagcggaaaatgtggtcacggggccacattcatactaaaaaagaagacagcatttaccgtctcctttttgccatccctttatcctgtcttctccgtgccctttagtccaagcctcacatactgctcttcaggtgcttgtgcctccctcatccctgcttccagttttttgcacatatcagcttctttttccgcatcttccaatctgttaagctgttcataatcattctgtaaatcaaaaagcattgatgtcattacatactctatattacctgaataatcttcaggaaacagcgccggaattttataaactggatagtgggtgtaaggaaggaatctgcccatttccattgcctgcgcatatcgctcatcaaaatatctccagcatgtggacggaattgcacagtactggtataaagggctgttttccctgttttcaggtgctctaaaataagtatatctgccgtcataaacattaactgctctgccgaaccagccataaatcacctgttctctcggcttttctctatcctcagcaatatcccggagactcattccttttacccgttccggtattttacatccatgatgctgcaaaattgtaggcataagatctatattctgtgtcagcgcctttacccttttcccggattcttttgtaccagggaaatgaatcatcagtggtatatgagccatttcattataggcatgcataatattttttccggtaaaaccatgttctcccagcatatgcccatggtcggtcgtaaaaataataagcgtatcttcatacatattattcttttttaatgtttcaagaagccttccaaaccagtaatcagccatgctcaacgttccaagataacatttttccagatgctccaccgcttccgcaggctctgttacttctgcatacgtgggccagcaaaattcccggcccacatagttgtcattatacatttgatgatatttttcagggcagtcaaaaggttcatgtggatcaaagctttctaccataagaaaaaaatcgtctgcgccattgttttgttcaacccaactacaggccgagcggaaggttcggggagaaggatattctgactccttcgtaaatttggttctgttaagcagatactgagatgacttttttccataactttccggatcaactgaaggctggttcacacgggaaatccaggtatcaaattcctgtcctctatgataatcccacgtattgaacaagtagcagtaattttctcctccaatttcaaagtaatgtgtgtgatcggtcgtaatatgcgtaaaaacgccattttcacgcagtacggaaggaagcgtaatatcaaaaggttcaacaccgccccatcccctttccaagaactgcatccgtccggtaaaaatatcccttctggcaggcatacagggtgcagaaccgataaaatgattgtcataaataatacagtcctttgaaaaagcatttatattcggtgtgattccttttgccctctcattatatgtttttaaataccgcctgttcagtgtatccattaataccaaaatcgttttcataattcccccctgttctgttatcccttaattccggttgtcacaattccctccacaaagtatttctgcataaatacatacataacgagtagcggaagcataatcagcgttgtcgccgccatcagataattccattgcgtaataaactcttctctgaaaacactcagggcaagttgtaccgtccacatattttttcgtgtggttataatcagaggccacgtatattcattccatgtacttgttgttttaaacacaatcaatgttgcaaatatagccttgctgagaggaagatatacgcgaacaaatgctccgaatctggatagaccatcaattttggctgcatcatccagagattttgggaagttcataaaaaactgccgaaacaggaatacaccgaatgcacctgctatgtaaggagcaatcatacctgcataggtattgatcaggccggttcctccctgccccagaatattgtttcctcccataagaggaaagtatttcatcgctacaaaattaggcagcatggtaacctgttgaggtatcatcatacccacaagcgcaagaagaaacagaaaatcctttcccttaaattccatacgtgcaaatgcatatcctgccagagagttaataaccaggctgataatcactgccagaaatgttgtataaaaggagttccagaaaaatcttccccaatcagatgatttcatggcatccgcataattggaaaacagccagtgttccggtaacagccggaacgccgcaccggaaatttccgcctgggttttcaatgatgtaaaaaacataattaaaaaaggaataattatgataacgcagaacaaaagcatcagcagaaataaaagtaaacgggcaccctttttcattttcatctgttttctcctctatccgatatccaaatcctgtccctgattcccatatctgaagttcagcagtgtaaatatcagaataatgagcagcaggaaaaccgcctccgcagcgccgtaacccatccggtattctgtaaaagctctcgtgtaaatctgatgtactattgttgttgtagcattcatcggtccgccgccggtcattacattcacctgctcaaatacgttaaacgcattgatcactccggtaatcacaataaaaaaggttacagggcgaagcattggtattgttattcggaaaaccttctgcagatagccggctccgtctatggatgccgcttcataaagataagaagggatgttattcaacccggccagatataatgtcatataataaccgacccccttccacactcccataactatcattgcgcccaaagctaatttttcatcatacagccattgcctggcctcaaaaccaagcgcctccaggattacgttaaacacaccgttagtaggatcatacagccaaagccagaccatcgacattgaaaccatggatgtgacgtatggaagataaataaagcctctgaaaaaacgtgtgccccaaagcgccgcgctatttaaggccagtgcgaggacaaaccccagaatgagagtcataaataccgtaaataccacataaataaaagtgttttgcacagatttccaaaacagcccatcatggaaaagagcaatataatttttaattccggtaaaagaaattgttttcagattaaaatctgtaaaactcaatccaacattcactacaataggaaataatacaaataaaagaaaaaatatataatatggagcaataaaccagtaagcacaccggtcggttgtgacaccctttttctttttcatccaaatccccaccatttttattagttctatagcagcgggcaggtttagcctgcccgcattgctgtactgtttctgctattctatctccttttccaactgtgacagcgcatcatttaacgcctgctctgctgtcttctttccattgattacttcttcataagcaacggaaacatatttattgtagacactgatccagggcacggtggctttgccttttccactttccacataatcaataaccgcttgattcagttccgggttccctgattgaatgaactgctcttccaaagatttttttacgattggcaccttaaagtcttcggtcctcatccagacaatttcattggaaagcatatgctgcataaacagccaggctgcttccttatgctttgaggttgctcccattgctatcagattatagccacagaaggaaatcccgggttctgagccgtctttcgacagtaccggaagataccccaattcaacttccgggttatccttcataaactgtcctatctgctgaggggataaattgctgatggccgacattcctttcataaatggccgttcatctcccttctgttgatcatgaggaatggaaacattcatctgtgccagttctcccagaaatgagaaagcatctatggctgcctgatccgtaaacgccggcttcagattcaattcatcaattaccggtgaacctgcacttcgcatataaggttctgtaaaaacaagcgagctgtcaattgagggaatatccagaccggcaaaaaccactttatccccatctctttcggttaatacctccgccgcattttttagttcttcccatgtagccggaggattttgcggatccagtcccgcttctgtaaatttatcctttcggaaagcatacacctgaggattggggaaaattcccagtgcaacctgattcccctgatatttccccatttcataagcactgtcaaataaatcgtccttttcctcccatccctctatatagctgtcaagcttttcgaaatcacctaaagcaccccgggacccgacttccgccaaaaccagctgaataacatccggataggtatcacttaaaacagctgcatttaatttcgtttcctgatctgaaatcgttgaagacattccggtagcttctacctttatattaggatattttgcttcgaaggaatccacacatttctgtacgaattccgtatctgcctgtgatgttccctgatgccagtattgtattgttacctgttcaccgctttcagatttttcattggttccctgtgcctgtgtactttcctgtgccgatactgcgctgttttcctctgttgcagtgtcctgtggtacctgctgtgtatcgctgctgccacagcctgccagcatagctgcccctatcataattgccaataacctttgtactttatttcttttccgcataagtccctctccttccgattcttacaacagctgaaggccttcattccttgtaaagccatattaacattaccgtataaaaaatactgcttctatttattggcagttttaaaatatattcatataatctctttttatttttatgtgcagttttatttttataatattttttgatccttttctctaatcttctgattgtgcattttatacatttcataccatttgccaactacacttttgtattatataatgaatgaagtccagaatgaggtgaaaacgatgcggaataaaaaaagtatttcttttcagataattattacggttatcatatctttccttgctttattcctttttttctctatacttactaccgaactgtattacaggaatgtaactgatattatgcaagaatctcagcagcattcccttacacagttaaatgaaagctttgatgttttttatcagcagataatttatattctgattcaactgtccggtgataccgtattaaaacagtatcttacaaaggaaccggaagacaactttgaatattatcagatgcaacggtatgtacatgattttctccaaacctacaatggtttttttcccaattctaacgtacacctgatcctatatggtgaaaacgggcagacttataccacctataatgaaaccttatatttagaagatactggtatccttaaagaagattttgtaaaacaggcagaaaaaaatcaccgccggcttggagtgtcttatttccattccggtctgaccccctacacccaaaatgatgattacatgtattttgcccacgccttatatgatccctaccgttccagatattatggcacaatcctggttgtaatagatgagtcatgcttccagaatctgtattccgatttaatccaggataacaatcatttttctgttattacagaggacggcctcattatttccgacagcaaagctgaatttctcaacagctctgattccacccttcttgatatcgccagaaaaaactccgacggcgtattggaatatgcgggagaaaagtggattccaagctccatatataaccagtatttcgatttttatatcctacagttaactgaatataatgccattacatccagagtctctccatctatcctgcggatattggaattatgctgttttgcccagctccttataacagtggttcttatatgtctccttcagaaaatcacacgcccaattcacaggctgtccgtagccatgcagaatgtttcagacagagatcttctctcccgtcctgaaaaaatgaatttcacaggttgttcagaagcccggcttctcggtgaaagcttcaatgaaatgttttcaaagcttgaatactatacaaaaaaactaatgcaggaacaggatgcccgtcatgcagccgaactgaattccctgcagcaccagattaacccacatttcatttacaatacgctcgcttccatcagatacctttctatggcaggccagcgggaaaaggtcataacaggaatcaactctctcacaaagctcctccgaaaaacgctgggggatatcagagaaaccattcctttggagcaggaactggatttactgcaagattatttccaaatccagctgttgcgctatggtgatggcatccgtctttacttaaatgtacaagagacctgcctttcagctgcggttcccaaattttttcttcagcctctggtagagaactctatttttcatggcttctccaccaacaccccctgtggcagtatcagcatttacgccacgataaacggcgcaattctgaaactggaaattatggataacggtgctggaattccaccggatatcctgatgcacattatggatgtttctgcaaaaaacaatcgaaacagccttacaaagataggtcttaaaaatattgaagaccgtatcaaaatgatttatggaccccaatatggcctcaatataatgagcactccagggtatggcactcaggtaataatacatctgcctttgatatattttgagggggaaaaatgctatgaaaaatcttcagaagatagtcatcattgatgatgagatggttcttcggaacggactgaaatatctctgcgactgggaggctcatggatttacaattgcaggggaagcctctaatggcattgaaggttttcagctgatacaggaaatccggccggatattgttattacagatattgtcatgccaggaatggacggcatcagcctaaccgcccagattaaagagcatttccccaatattcatattattgtccttagcagctatgacaattttgcttacgcaaaatccagctttaagcttggcatcgccgattatctgcttaaaccggaactggaagctgcagatcttcttcatctgctggaaaagctcagcaggacttctggtttggatgatttcaaaagttccgcctctcagtttttccaagaaattcttacattctgcagcctggaggaggaggaatatctggaggaatttaatgacagaggtatccattttaaagaaaaaataccatatacgctgatggcagctccctatcaggggactataccggttcacaggcttcttcctgccgtgacaaatctttcactggagctatttccggcctgtccctgtatctcttgtgtcacaagtcagggctacctctgcatccttcttcaggcagtaagcgctacggaacttccgtctcatgcccggcttaccgagtttaccgttcagctggaaaggaaactggaaaatagttttcttttcgcatgcatgccggtattctccgtactcagtaacctttctcaggtatatggagaaatgtgcggactgctttcctacggtttttactttccggaaaaaacattactgtttcctgaggatgtccataaatgcgagcttgcttttcctgatacttctttttcaaattgtctggatccattacgtcttgatgatgccagaaatcttgtatacaattatctgagcaatgcagaagcacaggccggcatggatgtatttaccttgaaaaaacaagtagagaatgcaatatacagactcatacagacgcttgcggacgcctcgtttccaaccgatgaaataaattcaaaaaaggtaatgtattttaaaaaaatggatatgtcagctgactgtaattctctcagacaggttctctccgaaacatttgccgagctggaggatattgtccgtaagggcacgcaggaaagagagggtaatctattctacaaaattgaagaatatatccgtctgaattgcgaacaggaactgaagctatacgatctggccaaacagtttcacctgaattacacttacctgtccacacttttttatcagaacacagaagagcatttctctgactatctgaatcgtatgcgtgttgaaaaagccaagggacttctgcgaaccgaaaataactccattcaatgcatcagtgaaaaatgcggctttataaatcaaggctatttttcaaaaatattcaaaaaatttacaggctgctctcctaaggaatatcaaaagctataccacaaaagccgctgaaatgtgccaaaaaaccctgaaccgcaaaagcgggagccggttaaggaaacttttttagttttgtgataagcagcgtaatgtacgagagtatgttacgctgcttttcctttcaattcgagttgcgccacaagctgtgttgcaccaacttccccgataaaggtatagtagatgtcaattttctgctggcggtggccgctgctcttgtcaccctcatggataacaattttctctatcagatcgtgaagcataccacgggagagttcttcaaaagaagtgtacttcctggccatcttcaagaagctgtctattttaatgactttgctttcagcttcattgacctgtttctgaatatctgcgatttcagaacatgtatcgcgctgttctttctcatagtctgatgacagttttttgaaccgttcgtcagacagctttccacttatattgtcctcataaagccgtttgatgatgttatccagctcaccaatccgacgctcctttgcagccagttcctttttcatggactgtatctgcttttgctgctcctttgcggagcgattcattaaacgccggacaaattcctgttcgttttcaagtgcaaaagtaactgtctgctttaggttttccaataccagattttccagaaccactgctctgatgtagtgcatggtacagctatttgtccggtcacggtatttcccacagcaatagcactcctgatttttactgatattctgtccacggtgagcgcggagtggggaaccgcagtctgcacagaacagcaaaccagagaacaatgccatttccccctgcttggtaggacgtggccgcccctcccgcagtcgctgaacctgctcccaaacctcttgctctaccagcgccgggtgagtattctcaaaaatcatctgctgatcctccggggtaggcagccgcttcttgaacttataagacttggagtaggttttgaagttgaccgtgtggcccaaatattccttatattccagaatgttggcaatcgtgctgtcagaccagttataaggtgcttccgggtggtagttccgctttttccctgtccggcggaatgccagcgtaccaggtgtggggatttttttcttggtcaggatatttgctatccgaaccggccccagcccctgtgcggccagatcaaacatcagcttgactacccaggctgcttccggatcgggaacaagctggccaccttcgcccttaatatagccataaggagggttgctgcttatccgttgcccggacatacctttcattcgcttgaccgccctttgcttctttgagcagtcacgggcataccattcattgaacagattgcggaacggggtcaggtcattttcgcccttttgagaatctacaccgtcattgacagcaacaaagtgaacctcatattccgggaagatcatttcactattatagacaagagcacaaaaagaataggtacggtggggattaacctgtcagattttccattcaatttctaccttttcatttgttgcccggatgaccgttatcagtgcgtccaccacctgcctcttgtcctcaaagctgacattctcccagtcatccagatacccggaaatgctttccatcttctccatcggcacagcgtccgcagagagttttgcaatctcattggcaatggactgccgccttgcgtccagatcctcaattttgctgttggcataggagagcaaaacagggcttgcgcccgtcagcgtgtcaagcagcttttcaatctcgctttccacctgcgccagttccagccgctttgccgccagcttcggggagattttcgccgcttttttccggcctgtcagcgtcttaaaatctttcagcttcttcaccatagccccatagaccaccgcttccagttcgtgcagcttcacgcacccgcagccgggacacgccttgctgtccgcatggacggtgcaacgcatatagaggatgccgttggagtgcgccgacataagcgcatacccgcatttcccgcatttgatttttcccgccatccatgtgttccgggctttccttgcaggctggtaggtgtggctggcaagcagcttcttccggcatttcagccacagctccgatgggataaacccctcatgtggagccagtaccagcgtctgtccttgcaggtgcttgtgcttgtcctctgtattccccttgccctgatagtaatagcagccgtttgtcccggcaaagtcggcggcgtcattgtaaatatccgtcccctggcttttgtaaaactcgtatatgtcgaggtcagccatgacataaatcgggttgcggagaataacgctcaaagtagcccttgacagcggcctgccatgataagtacgcataccgtccgccgtcagcttctttgtaatgtcatgcagcgatacctgcgggtcagcgtacatctcatacatctgccggacaaaggccgcttcgtttggctctattaccagcttctttgtgcgcaccccgtccatcacataaggctctgtccgaaatccgtagggcgttttgccgcccattttgaagccccgctgacagcgggagtaccatgcgtcctgcacccgcttctgtatcgtttcccgttcaagctgggcgaacacgatacagatattcaacatcgcccgccccattggggtggaggtatcaaacttctccgtagaggacacaaactccacttcgtacttttggaagaagtccatcatcttcgcaaagtcgagaatggaacggctgatgcggtcgagcttgtaaaccaccactttccgcacaaggccgctttcaatatcccgcataagctgttggaattgtggacgctccgtatttttcccggaataccctttgtccttgtactctttgcagttcccgcctttcaattcgtatttgcaaaactcaatctggttttcaatggaaatgctatcctttttgtctaccgattgtcttgcatagattgcgtctattcgattgttcatattatcgctccttttcttaaaaaagaaacggagctgctgacagttttattataccgccagcagccccgcaaatcaacgatggctttggaaaaccttatgccccgacttcctcactctgccgtttgtcggcatacttgcggaacacctcataaagctgctgttccagctctcggcgttttgccgcttcctgctccggcgtgaacaccggggagagattttccagcgtgatttcctttccctgaaaagtcacgacttcggtttcctttttgtatctgatagtggtacttataaaatcacctttcctttccatgctgccgcttctgccgtttcagttccgccagcatatctggcgggatacggtcaaccagccgctgtaaattgtccagttcgcttttcagctttgccctttccatcgtatctttcatcttgcctttttcaccggcttttgcccttgcttccagcttttcgttttccgctaacaggtcattgattgtgaccttgtattttttcagttgcccggagaaattctccatctgcgggaaccactttttcagcatggagagggcttcctcttttttctttccggcgttgaacggggtaatatcgcccagcgcggcttcaatggctcttgcctgtttggagagattgaccgcctgcttgaacagacgggtggggatatgcttcctgcctgtcttgctggcactttccccacgctccaagtcaggatatttctccaccatataggcgtgaaaatcgtcctgccactttgtcaggtttgcccggttgccgataatctcctttgcacacaggcggttgtcctctgtcagcgggacaaaggtcaaatgcaggtggggcgttttctcgtccatgtgtaccacagcagacacgatattgtcctgccctacccggtcaatgaggaaatcagccgccctctggaaaaacgcctgtatctcctttggggatttcttcttgaaaaactccgggctggcggtgaccagcgtgtccacaaaccgggtgctgtccttacgggtgcggcagccagcctgttcaatgcggttctggataaagtggtagtacctgctctccggcttgacgatatggaagttgtatttgctccggctggtgtcaatgtcgggattgctggcgtactgttccttttgccgttcgtgatgggcttccagcggtcttgccggattgcccttgtgcttttcaaatcgcaaaattgcgtgttgtgccatgaaactcctttccccatgcccttccattccgtgacttttccacaggaaaatcccgcagaaaatatctcagataggaagggaatggataagatataaataaaatcgttttaatctctgtatttctatataccgtccggtttccgtactccaagagggttgattatcgtactccatgagtacggttttcagtcctcctgcgtaccagaacgggatttcttgaagtcggtgtttggaaccgcttcataggattttgggtaaatgcggttgggttttccacagccctgcttctggatctccaccagtccggcatattgcagttcccgcagggtgttgaccgctttctgccgtccgcagtggagcagctccactacttcgttgatgggatagtagaggtaaatccgcccatattcatctgcccagccgtttttccgggacaggtctgtccggcgcaggacaaaggcatacagtacctttgcttcgttggacaagggcgtgaatgtgggggcttcaaaaaggaaattgggaagccgggtaaagctgaccgccttttccggctgatggatataaatggtgtttgtcatatcgtgttttgtggacggttagaaccccgttttctggggcagacggtagtttctattgcctgtccctgttctgtgcttgcaaagccttgtaaatcaaggacttttcagcccctaactgtccacacaagacctccttttccgttcactttctgttttctgccgcctgtgaactctggcggcacagccgggacagtatttcgcccggttggactttgggacgaacacgccgccgcagacctcacagcatttcaagtcctttccccggaaaatctctgcttccagcgtacccgcttgtggtaagacagaccagcggaaccacttgcagcagaccgagaaagaaatggcctgggggcaggtgtgggcgtccccatcgtccaggagcatacagttcccgtcctcatagttgcagcactcccggcggataaggggatttgcctgtttcctctgtgccggtgtcatgcggtaaagggaaccgtcctgcctgcgctctatgggcggcagtcgtttatatgggttctctctcatgtgttccctccatttttccttagccgttctccctgaaaaggcttcctgcctcgtcgtcgcaagttgcgtatcgttcgtttcaccgcaagcggcaaaactcactcgctccgctgctcctcctctccccacaaagccatgcgactttgcggggaccccgacaatggcggcgtgttccggcgttggcacgctccccggacttcgggacattttggagccgttgacaaacgcctattttgaaaaaagctttgattttcctgcccggtctttgtcgattttatgacagaaacggctttttcctgaacttttttcaagacgatttttttagaaaaccactttgtcaacagccccattttgtcccgaagtggctcgttgcggtgcttcccctgccggggtattccttttcggacggtcattctgttttcaaggtgcagctcatcgatgaactaccttaagtctacacctaaaagaccgcccgccccgtatatccataaggtcggaaatcagcccggaaaactctctatttccacgctcttggaattgtggtagaatagaagaaatagaatggcaaatcgaaatttcacggaggtatattatgggactgttttcaaagaagaaaaatgaagaagtggctattgatgaactaacaccacaaataaaaactaagttagatgaattagcccaaaaaggcaatcagtttgaggaagaagaacaatatgaggaagctatacaagcatggaaagaagctcttagcctaatcccagagccacagcaattttacagtgaaaccatatggtttttagctgccattggcgatatttattttcaaaagaaacaatacgaaaaagcacacgaatgctttgacaaagcaagggggaatttgagcggcgagggatatggaaatccgtttgttatgcttcgattaggtgaatgttgtttagaaataggggacgaaaaaaacgccacagaatatttgcttagagcctatatgtttgaaggaagggagatatttgagcctgacgaggacggtaatgatgatggcaaaaaatattttgattatttaagaactcatgttgaaaacattgagtgaagatttagtaagacacagttcccatttatcgagcagacaaggagggagagcatggaactatccatacaagaacgattgaaagatttgcgtgtggagcgtgggctgacgctggaacagcttgcggaggaaactcatctttccaaatctgctttaggcagttatgagggagacaatctcaaagacatcagccaccatgcccttatccagctggcaaaggtttatgaagtgaccattgattacctgctgggacgctctaaaacaaaaaatcacccaaacgccgagcttgcagacctgcgtttgagtgatgatatgattgaactattgaaaagtgggcgggtggataattccctcttgtgtgagctggcggcgcaccctgattttccccggctcatggctgaccttgaaatctatgtgaacggaacggcagtcaagcaggtacagagcgcaaatgccattgtggatattatgagcgcaaccattatgaagcagcacaatcccggcttgtccgacccgcagttaagacagcttatcgccgcccatattgatgatgacagcttttgccgctatgtgatacagcaggacataaacaagatagctcttgacctgcgggaagcgcataaggacgattttttcagcgtcccggaggacaatcctctggaagattttttgcagaccgccgaggaaaccgccagcccagacagcgacccggagcaagcggctttggcgtttatctgtaagcggctcaaattgaatttgaagaagctgtccgaggaagaaaagaagtggctgaaaaagattgcacagaagtcggacttgctgaaaaatccgaacccgcagcgggggaggaaataagaaattgataaaattgaatttacttttttaacaggaggattatacaatgagtatggatttgaatttttggaagtacaaggaagataccgcacatgaccattcaaccgtatatcagacagcgtgttgtgatggcgaggtaatggaagtattggaagttcttccgattgacgagattttgaaaaaagtggctgattctttttctgactggaatatacaaggtggaggcaaagattttgaaaaagaaggacatggagcatttcagatttttacaacttcgcaaatcgtaaggtttgattgctatggtatgcaagaggctgatatgaacgctctcatggatattttacttgattttggttgccctctatacgacccacaaatttcaacgagattcgattcttggacagatagataacaaatcccatttatcgtggagatagcaaagccagccgagccagtcaacggtcaagatgaacggcgcataaatgcgccgccgttgacagcctcgcccatctttgctgatgggtaatcaaggcgggaaagccctaaaacggcttcccgcccattccgattttgagaagaaagtccgtccgctttttcgtgggtgtggctatccggctgggacactttgtcccacagtccggcataggacgagggacggggctttcatatacgccctgtctgctgatgaaaccagtcctgcgcttgcggctccatgccacgcaatcacagccctgttttcctgccgtttcaaatgcccttgccctccccggcggcaaccccattttcgcagcaacgccgacagagcgtataacacactacactttgctacgcaaagtcgtgtgccaaggggcaagcccctttggaaaccccagacaacaaaacaggctgaatatctcgcacttccccggtgcttgatattcagcctttatttgttgtcagcagcccccgtttcgtggtctgccttttgtgtccttgtccataatgtttccgtatacatgcccacctgcaagtagtcacggccaaatcgcgacatatccttgataatgaccctttttactaaaccagcccgcacatcagctaccattctttgaaaatcagggcggtcaaaagctgacgttagataacgatacttttgaaaacactggaaaatcaaggtttttcgagcgacggacaagcagggtattgtactaaaaactgaatacgacgcagaagcggcgtttcttactctctacatgggagaacaggaacgccgcttttttatgccctttgttacgcagtaggggcagaaaaagccttgctacaagcgattttgcgggcgcgtatctggcgcggcaagggatttataccttatcccccgaaaccgcgcttctactgcgtaacaaatccacagcaaaaggagtgatttactatggcagttttcagagtggaacggaacaagggctacaccgtaatgagcaaccaccacctacgcaacaaggagctttccttaaaggcaaaagggctgttgtcgcaaatgctgtcactccccgaagattgggactacaccttgaaaggcttatcccttatcaaccgggagaagatagacgctatccgcgaagccattaaggagcttgaacgcgccgggtatatcgttcggtcaagggagcgcgacgagaaaggacgcttgcggggcgcggactatgtgatattcgagcagccgcagccgcctacgccggatttacctacattggaaaatccaacattggataatccaacgcaggaaaaaccaacattggaaaaacctacgttggaaaatccaacgcaattaaataaagatatacaaagaactgacttaccaaaaaaagaaaaatcaaatacagatttatcaagtacccattccattcctatcctttcccctaacccctctccttgcagagaagcggctacgccgccggaacggaaaggaacggaagcggcagcacagagcgcagttgatatataccgggaaatcatcaaggacaatatcgactaccacattctcaaacaggacatgaagtttgacggggacaggctggacgagattgtagacctcatgcttgaaaccgtatgcaccgccagaaagcgggtacggattgcgggggacgactacccggcagagcttgtgaaatctaagtttatgaaactggacggcgagcatatccgctttgtgcttgactgtatgcgggagaacacaacgaaaatccgcaacatcaagcaatatctgaaagcagcccttttcaacgccccgtccactatcggcaattattacacttcccttgtcgcccatgacatggcaagcggcgcactgtcaccgaagaagccgcagtacggcgacccggactattattcattcaaaccgggcgaaagcctgtaaaacaacaaaaggaggattttattatggcacagaaaatgacaggagcattggtatttgacgagcgcaccgaccgttacgacattcgctttgacttaaacagctactacgggggcttgcattgcggtgagtgctttgacgtattcgtgcggggcaagtggaagccgacccggattgagtacggcgacaactggtatcttgtgggtatcagagccgaggacttgaacgggctgcgggtgcgtatctgaccgccgccccataaagaaacgcgaaaggaggacgcgaggaattgcaggacgaagtaaacgaaaagaccatagccctttacatcaagaccgggaagctgaccgcccagacgctccaaaaggcaatgaaagccatactgtcaaagggcaaaaagcagcttgcaaaaccgccacagggaaagcagagcttaaagcagcttatgaagcagaacgcgggcgtttccaacattgagattaccgagggcaatatcaaagcctttgagagtacggcgaaaaagtacggtatcgactttgcgctgaaaaaggacgcaacggaaagcccgccccgctatctggtttttttcaaggggcgggacgcggacgtgctgaccgcagcctttaaggagttttccgcaaagaagctgacacaggagaaaaagccctctatccgaaagctgctctctacgctcaaagaagccgcacagggcaagaacgcggaacgggcaaaggtcaagaacaaggacagggaggtatcgctatgaagccggaaatcaagaagctgcttatcctaaatctcccgtatctgctctttgtctggctctttgataaagtgggcgcggctgtccgtctatcccccggcgcggacgcaagcgcaaagctgctacatcttggggacggttttaccaccgccttttccagtatcgcgccgagcttccacccggcagacttacttatcggcattgcgggggcggtcattgtccggctgattatctacaccaaaggcaagaacgcgaagaaataccgccgcgggacagaatacggttcggcgcgttggggcggggctgacgacataaagccgtacacagacccggtatttgagaacaatatccccttaacgcagacggaacggctcaccatgaacagccgcccgaagcagccgaaatacgcaagaaacaaaaatattcttgtaatcggcggttccggcagcggcaagacccggttctttgtgaaaccgtcgctcatgcaatgtacgtcaaaggattttccaacgtcgtatatcgtcactgacccgaaaggaacactgattttggaaaccgggaaaatgttgcagcggtacaaataccgtatcaaagtgctaaatacgattaacttcaaaaaatccatgaaatacaatccctttgcctatctgcggagcgaaaaggacattttgaaattagtcaataccattatcgccaacaccaaaggcgacggggaaaaatccggcgaggatttctgggtgaaagcggaaaagctctactacaccgcactaatcggctatatctggtatgaagccccagaggacgagaagaacttcacgacgctgcttgaaatgataaatgcgtcggaagcccgcgaggacgacgaggatttccagaacccggttgacctcatgtttgaacgtctggaagaaaaagacccggaacattttgcagtcaagcagtacaaaaaatacaaactggcggcgggcaagaccgcaaaaagcatacttatctcatgcggcgcgaggttagccccattcgacattaaggagctgcgggagcttatggaaaccgacgaaatggagcttgacaccataggtgacagaaagaccgcccttttcgtgattatcagcgacaccgacgacacctttaactttgtcgtgagtattctctacacacagctattcaacctcttgtgcgacaaagcagatgatgaatacggcgggcggcttcccgtccatgtacggtgcttacttgatgaatttgcggtgcgctcgtaagcggaacccattcgttccgcgcgggcttgtttgtaatctatctttagcaagatagtaggttcaatgtgagggcttcgcagaagcctaattcctatcatcaaccgacttatccgaaagggaaaccggacggggagtatagcatgtcggtaacggtgctattcagtcagctatcagactgtgaacgggcatcaagatgaaacgtcatgtatgaggttaaacagctatactgcttaaatgacagccagaggggctttatcgtcagcactgacggaagatagctattatacgtcaggcagtgcagggtgtacgcagagttgtgcgaactgcgtctacacatcacattccgcactgaccagccgcaataagcggaaaatggcgaacgtcgtaaccgacaacatgacacgcttgtacagacaagcctaaacgaggatagtctaaacaggaacgcttatcattttaagctatggcagtaagtgtctgaatatcctgcaaggctacggagtctccatagtagtctgaggcggtaataccgtacacatggcgaagggagacagctatacgactgaaataatttaggaaaggtgtgtgagacactatgagaagtccaaagattattttggaaaatctacagaaacactcgaaagaggaaaactacaagtatgagagactgtataggaatctttacaacgaagatttttatttgcaggctctccaaaacatctatgccaacaagggagcgatgacacccggcatagatgggctgacactcgacggatatggtaaagaaagagtggagcggattatcaatgcagtaaaagaccacagctatcagccgaatccagtccgcaggcagtatatcaaaaaaaagaacgggaaaatgagaccgctcggaatctcatcatctgatgacaagctggtggaggaaatcgtaaaaatgatactggaaagtatctatgatccgacgttctccaactattcccacggtttcagaccgggcagaagctgccacacagcacttttacagttacagcagaactttactggtgtgaaatggtttgtggagggagatataaaatcgtattttgatacgatagaccaccataatctcatcaatatcctgcgcaggaggataaaggacgaagcatttatagagcttatctggaaatttctgggagcaggatatatggagaactgggaatacaacgctactttcagtggaatagcccagggttccggtatcagccctatccttgcgaacatctatctgaatgaatttgacagattcatggaggattataaaaagaagttcgacaggggaacgggcaggaaaaggaataatgaatacaccagaaaacagtcgcaccgccaacgatgcaagaataaaatccgaaaagaatgggacggatactcggacgcagaaaaacaggaggcattacgccgcctgtcagagctaaaaagagagttccagaaaatccctatgggagacccgatggacaaaaactataagcggattcaatatgtgcggtatgccgatgattttcttattggtgtaatcggcagtaaagaggacgcagaaaagattaaagcagacatcgggaaattctttgaggaaacgctgaaactggaattgtctgcggaaaagacgctcattacaaacagtgacgacaaagcgaggttcctcggctatgacgttacggtatgtaacgacagtgcagtgaagaaagccagaggaaaaggtacaactaaagcctatactggcaaaatcaagctgtacctgccgaaagaaaaatgggtaggtaagctgttaagctatggcgtgctgaaaatcgtgtcaaaggcgggagaaaaagaagtctggaagccattacagcggaatgactatatatttctgccagtgcatgaaatggtgcggaaatacaatgcgcagattcgggggatttataactattaccgccttgcgagtaatgtttccgtactgaataagttccattatgttatggaatacagcctgtacaagacagttgcggcaaaataccgtattacgatgacaaaagcaaagctcaaatataccaaaaacaaagagttcagagtaccgtacaaaacccagagaggcgtgaagtatgcagtattttacaacgatggtttccgaaaagtgaaatatgctctcggaggttatgttgatgtaatacccgaatatgagcagatgaacaagccgaaagaactgtttttcagatacaaggcgaacgtctgtgagatgtgcggtgcatatgtgcctgcggttaaggtatatcaggttaaaagtatgagcgaccttgatgtgaacacagactggggagcgattatgaataagaaaaaaagaaaaacgcttgtagtatgcggagactgttacaacagaatccataaataatgtagagaatgtatagtggggagccgtatacatcgagaggtgtacgtgcggttccggggcgaggactcggaaacctgctgttgtgaagcagtaaggcgccggattcttagcctacaatatcgggcaaatccccaaatttgagaaactaatcgcaaccatacggagccgggaaatctccgcgtcaatcatcttgcagagccagtcacagctaaaggcaatctacaaggacaacgccgataccatagtcggcaactgcgacaccacgcttttcttgggcggcaaggaaaaaaccacgctcaaagaaatatcggagattttaggcaaggaaacgatagacagcttcaacacttccgaaacaagggggcgggagctttcgcatgggctgaactatcagaaattgggaaagcagcttatgacggaagatgaaatcgcagtcatggacggagggaaatgtatcttgcagctacgcggggtgcgcccgttcttttcggacaaattcgacataacgaaacacccgaaatacaagtacctatccgacgcagacccgaagaacgcctttgacatggaaaagcaccttaaacgccgccccgccattgtcaagcccgacgaggtttttgactattacgagattgacgcagcagacttacaggaggacgcagaccatgaggaaacgtagcgcagaggaaaaacaaaagcagcttgaacggtttttaatgaatgttgcggaagccgccgacgctgcattatgggagtattggcgggaaaaggaagcggaacaccgccgttttgcaacggagtatgtcacgcgccgggggcttatccctcaacagtgacagcatggcagaccgccggggagggggggacaggggaagctacacttcccctacgctgccttgcggcagctacccctttgtgaacttgcgggaagcgaacaccttgctatgcaagctattcacttcccgcaagtctgaataatacccgtccggcagcacagcgggacaccgaaaggaggaatcgaagcaatcacatatatcaatatcggctacatgatacgcgcccctactttccggcgcagcacacagcggcaggagccgcacccccctacaactgaataccgccgcgccgcagaacttacgcagcgcggggacagccgcctttaccagagggcggtttttttatgcggcggcatacgctgaccgccttttgtccgcttgccggacagccgcagacgcggcagaaaggatttatttatggcatttttcaatagcgcagtagacgttttgcagacccttgttgtagcacttggagccgggcttggtatctggggcgttatcaatctcatggagggctacggcaacgacaatccgggcgcgaagagccagggcatgaagcagttcatggctaattaaagggaacaaaaagaaaggaaaagcacaatccagacggtatcagcggcagtccacaagaataaattgtgatttcacaagattggtgctataataagagaaaagttcctgccggggcagccgccccggtggtatggataggaaggcgggaaagcaatatgcacatcagctataaaccactctggcatacactgttagagcgtgatatgagaaaagaagatttaaggcttgctgctggtatgacaacgaatatgattgccaacatgagcaaagagggaaagcacatcagcatggatacattagcccgtatctgcgaaacgctgaattgtgagattaccgatgtgattgagttagtatcagacgagcctgcttccacaggaggtaaggagcatgagcgaattgaaaccaagaataacggaaaacggaattgattatatccttgtcggagattactatatcccagatttgaagctgccggaggaacaccgccctatcggaaagtacggacggatgcaccgggagtatttaagagaagtccacccagccaaattgaacaccttgaccttgacaggggagttatggacataccttgcagacctgaacgaacaggcacaggaacggttagacaccatcatggagcagatgaaagatgccgagggcgtgaccgaggaattgaaacgaacccaacaaatggaatgggtgcggcgttgcaataacattcacaaccgggcagaagaaattattttgcaagagatgatttattcataacggtatggtagaatgattatgacaaataagaattttttgctccatacgcccttgacaatagtccttgcaatatactataatagtatttgtaaatactatttgcaagaggaggacttatggaaaacaatcattttaacgttgcgtgggcgaaaagcactgcgctatatacaaaagcagcttcagtacttggcgtcggatacccggaaatgatggtgctgtatgcgctggaatccatgggagaactgacgcaaaagcagatcgcagagaatttcggtatgcaaaaacagacggttcatacggtcgtgagcgcacttcaaaagaagggctatttactgttggaggccagcgagggcgataaacgtgagaagcggatcgtcttgactgaaagcggacaggtatacgcccacagaatgattgcgcctttacgaaaagccgaggagaaggtttatagaacaatcgggaacgaacggctccaagccatgtgtgaaattcttgaccttttcaatcttctctttgaaagagagctgagaggaggtctgggcagtgaataacaagcggactttctttcagtatgtgattccgtccgtgttatcctttgcgctttccggggtgtatgccatcgttgacggtttctttgtaggcaactcaatcggggatgccggactttccgcaatcaacattgcatatcccatcacggcggtcctgcaatccgtagggacaggaatcggaatgggtggttcagtcaaatactccattctgaaagcagcaggaaatgagaaaaaagcacgggagttcgttgccggtgcaacatggctgatgcttcttttcagcgctgtcctgactgtcaccgttttcttcacttcagagaaaatcctttctgcccttggtgcatcgggcgagttgcttactctgggaaatgagtatatcaaggtaattgcccttggagcgattttacaggtgttcggcaccggactggttccgtttatgcgtaattacggcggttctttgtgggcaatgatcgctatgatctgcggctttgctaccaatgttgctcttgactatacttttgtgtgggttcttggacggggcatgtacggtgcggcattggcgaccattattgggcagggagttaccatggcggttgcactcgtgtattgcgccatcaaaaagaacctcactctgaaaatcgcacctgttgataccccgaaaacggcatttcagatattaaaaatcggacttgctccatttggcttgacccttgccccaaatatctctcttgtgatcatcaaccgattttcggtttattatggcggacaggaggctatcgccacctatgcctgtatctcctatatcatctgcattgtttatcttcttttgcagggtgtcggtgatggtagccagccgctcatgagtcagttctacggagcaggcgaagaaaaatcgctcaaacaaaccaaaacgctggcgtatgaattttccatggttttggcggtaatcagtgcgattctgatttacctgctccgtggaaagattggactactgttcggttcatctgccgaggtaaacgcaggggtcataaaggtcatgccgatcttccttgtgtcggttccgtttgacgccatcacacgagtttccgcggcggctttctacgcaaccgaaaaaagtgtgctgtcctatgttctgacctttatcgaacccatcatcatgctggtgttgatgctgatgctgccgccggtgtttagcggtcaaatcacgatttggtggagcgccgtatttgcaaaggtcattaccgcatcagtaagcattgtgctgtccgttagatacagcgcacaaagaaatcgataacttccagtttatcgttctgattttcaactgaataaccacagtaaaaaccgctgctacatggaagctaacaaaccatgcaacagcggtttttctttaccgttttttcctttggctgataggcgttcccattttctttgattttttgagaatccgaatgagccagcgaaattcttcatctgacagatttttatagttgataccaagttgcttgcagtaaaggacaaccagcttttcatcccggctgcccttgaaattttcgaccgcttccagattttctttcagttcatcggcaacggtggtctggggtgcactctcactgtcctttttgtgggcttcccgaatatcccggataatgaggttgaggtcatccagaaccatgtgactaaaatactcatcatcgctgatatgggcggcttgcagcactttcaaatgcgggtcatcttcgccggggcgataccgttcaatgatttcatgccggacggtatcgacaagtgcattgagattttgaatctgcatggtggcaatcccgtccacataaatctcaatgtctgcaagaaacttgataaaatctttatgtgtggcaagctcacagagcagacggttgttaatccgaccgcttttcaggagagcaaccatctcatcattcaaatgcagctccgttagtggcgtgttgatctgctcccggttctctgccctgcacagtagataatcaacggaaaccccatagaagtctgccagcgtgataaggttgccatgattgatttccttaaaatcctctttttcataacttccaagagctgatttggaaatgcccgtcagctttgatagttcttccagatttaagcctttgtccttgcggagttcccaaaggcgttcctgtatgcttgttgctcctttcatgggcgcacgctcctttccaacggtttcattgctgccgcttatctggattatatcacactttccgtaatcgtggaaatttctgatttttacccttaattcctactttgtggacatacggcacagggtacaaaaatgttctatgatacaggtagttcatcgatggattattccaatcgaatgaccagcctgtgtgggatatgcttccccagcgatgtagcgccatgacttttggcagggatatggaggaaccctgaccgaaacgagcgtaccaaagggagcgatacgccgctgtgagattcaggggaggaacgacaccggggagaactggcggactgacaccgaaatgataccgaaacacgacaatctgatagggggatagtctaccctatcgctgatacttcgggagattttaggcggctctatgaccgtaattttgccgaaaatcgccccgaaaccatacacaaaaacgggaggaagcgcaatatgccgagaatgagcaaaaagaggaagcatgagctttccttttacctcaatgaccgggggcgtgtcacttacaacgaattatgccggaaatgccagcatgggtgcaggcagagcttccgggcggttgtggttgactgcccccgttatttatccaaacgagcaaagaaaaaggaggaacacaccgaatgaattttgaatttatgacgatagacacaccattgccgccgtgtatgccatttcccatagcgttgacaggatttccagtcagcagcaccgcaaaggtcatgtactgccggatgctggacgctatgctatccaaagggcaggaggacgaaaacggaatcctgtttgtctgcttccctgtcacagccattgccgcagtcctgtcccgcagctccatgacggtcaagcgttctctgaatgaactggaaaccgctgggcttatcatgcgggtgcgtcagggtgtgggagaaccaaaccggatttatgtgctgataccgggaaaggaggacgctgcccttgcctgagacctcaaagctggaaaagctaaaccgggagctggagaaaagcgaaaagaaactgcggaaagccatcaatgatgaaaaggcattgcagcaccagttaaagcagcttactcgaaaggaacggacgcaccggctctgtactcgtggcggtatgctggaaagttttctgcaagagccggaacgcctaacagatgatgatgtcatgctgttgttgaaactcatttttcacaggcaggacacgcaggaactattgaaaaaaatgctggaacgggagaagccggaaaccccttagtttactaagggcgcaattatacaccacccagaggttggcgcattgcgttctccgaaggctcctcgccggagagctgtgattttccgcagtcatggtctgctccaaatcaaacaggggacgctacactttccctgcgctggctgcagccagctacccttttgtggacttgcctgttggggacaccttgcggtgcaagctgttcccagccgacaagtttcataaaatatgctatcttttcgataatcgatgaagtataataaagtcagaaataaatcaggaatttgaggtcaaggcttaaacgtgaggtttatatgaaaaaataccaatgtccttgctgcggatattttacctataatgttccggcaaatgaagattgtgggtatatttgccccgtttgtttttgggagaatgacccgttcattgcttctgataacgaaccaagcgactctaatcatggaataacgctaaaagaagcgaaatccaatttctcaaaatttggtgcttgtgaaaaagaaatgttatgttatgtccgaccaccaagagatgatgaaaaagaaatttcatagcgacaacttccaacttgtagaactgaaaaattagaagttgtaaaggagtgtgataaaatggaaacactttttgaccaatacaaagaactgaatataaatggctctttgatttgtcttgaacaagttgaagatatttattcttacttctgctatccgaccaatgcaaaggcaataggttttgaaggaagtattatgtattgctttattgagccgtatggggaaatggtttttgcctgcaatcctgatacttgtgcagatgtttttgtttatccactggcaagaacctttgaggattttatgagacttattcttgcttgtggttctactaatcctattgagcagattatttggatggacaaagacaaatttgaaaaacacctcaaagaggaagaagcaatccgcacagaggaacagaaagcgacattaagttatcttgaaacagaattagaaatttcccctattgataacccttatgactatgtaaaagaactgcaatctcgctttgacaatagtggcattgagtatagtgatgaatactatgatgttttggggattgatagaaaataacaacaaataaattccagttcgtcagcttcacatcgggtcaacttgtcccgaacttttacaactaaatacccgccgcccacacagcggcacaccgagcaggaaatctgaaagaaaggtttcctgctttttttctgcccaaaatgaggtggtaaaacgccaccccgtccaccaattagcgaaaggagggacacgaaatgccctgtccacacaacgaaatcacgattgttcagcgcagccagcggcagtctgcggttgccgccgctgcttaccagagtggcgaaaaactgttctgtgaatatgaccagcaagtgaagcactacccggaaaagcgtggtatcgtccacaatgaaatcctgctcccacctaatgccccacaggaatatgcagaccgcaatactttgtggaacgccgccgaagcggtggaaaaacaatggaactcccagcttgcaaggcggtgggtgcttaccatccccagagagataccgcccgaccagtatgctgtccttgtccgggagttttgccagaagcagtttgtttccaaaggcatgattgctgactttgccatccatgacccccatccgccgggacacaatccccacgcccatgtcatgctcactatgagggcaatggacgaacatggaaaatggcttcccaagagccgcaaggtttatgaccttgacgaaaacggggaacggataaaacttccgtccggcagatggaaaagccacaaggaggatacggtggattggaacgaccagaagtattgcgaaatctggcggcatgaatgggaggtcatccagaaccgctatctggaagccaatgaccgtccggagcgtgtggacttgcgttcctatgccagacaggggcttgatattgtccccactgtccatgagggggctgctgtccggcagatggaaaagcgtggtatccagacgaatatcggaaacctgaaccgggaaatcagagccgccaacagtctgatgaagtccatccggcagcttatccaaaacctcaaaggctggattaccgagctgggagaaaaacggaaagagctgcttgcacaaaaggcggcggaggaagcgacacttcttcccaatctgctgatgaagtacatggagatacgaaaggaagaacggaaggactggacaagggctggacagaaccgggggacttcacaggacttaaaggcagtcagcgaagccctgtcctatcttcggcaaaaggggctttccactgtggaggacttagaagcatttctggaatcttccgggaaatcagccgcagattaccgcaatcagatgaagccaaaggaagcccgcagcaaagtgattgacgggattcttgccagccagacagcctgcaaggaatgtaagcctgtctatgagaagtaccagaagatattttttaagaaaacaaaggagaaattcaaacaggaacacccggaggttgcccggtatgagaaagccgccgcctaccttgccaagcacccagacgataaggacagtacccaaaaggagctgcaagaggagcaggaaaaacttctggaagaaatcgcagagctgaaagtaccactgaccgaggtacaggaggatttgaagaagctgcgggacatccgctactgggtacggaaagccacccccggcacagaagaaagcaaagagccgcccaagaagcagcccatcaaagaagtcttgcaggataaggcagacgagaaaaaagcacaaagaactgtcccggcacagacgaaacacaaacaacaggatatggaactttaacaggcacttgccattttcaatcagagaatgtcaggtgcttttcttattttcaaggagggacagatttgaatgtatttgaagctgtgaagcagtccgtcacaacaagacaggctgcggagcattatggaatccatgtaggtcggaacgggatggcttgctgtccgttccataacgataaacccccaagcatgaagctggatcggcgttaccactgcttcggctgcggtgcggatggggatgtgattgattttgccgccgccctgtatgggctgggaaagaaagaagccgccgtacaactggcacaggacttcgggctttcctatgaggactggaaaccgccgggaaaggcaaaaaagcccaagtcccggcagaaatccccggaggaacagtttcaggaagcaaaaaaccattgcttccgtatccttgccgattatctccacctactccgagtgtggagaaaggaatatgccccgcactccccagaggaaatctttcatccccggtttgtggaagccttacagaagcaagaccaagtggaatatctgctggatgtgctgatgttcggggaaacagaggaaaaagcggctttgattacggactacggaaaggatgtgatacagcttgaacagcgaatggcagagcttgcagccgcagacgcagcaagaactaaaaaacaccatgaacgccatgcagccgccccagagcgttgaggaaatcaaggcggggctggaaactaccgagaaaggcggtgtccgtcagagcatacggaactgcctgaccgtattccagcgtgacccgctgctttccggggctatcgcatacaacatcctgaccgaccgcaaggacatcataaagcccatcggcttccacagggaaagcacagccctgaacgatacggacatgaagtatctgcttctttatctggaagaaacctacgggcttaccaatgagaaaaagattgataacgccatcgggattgtggcgaatgaaaacaagtaccatcccatccgggactatctcaatacccttgtgtgggacgggacggaacgaatccgtttctgcctgcggcactttctgggggctgacgcagacgattacacctatgaagcattgaagctgttcctgctgggtgcaatctcacgagcctttcagccggggtgcaagtttgaaatcatgctctgtctggtaggcggtcagggggctggcaagtccaccttcttccgtctgctggcagtccgggacgagtggttctccgatgatttgcggaagctggacgatgacaatgtgtaccgcaagctgcaaggtcactggattatcgaaatgtcagaaatgatggcaaccgccaacgccaagagcattgaggaaatcaagtcatttttaagccggcagaaagaggtttacaaaataccctatgaaacccacccggcagaccgcccccgtcagtgcgtgtttggcggcacttccaatgcccttgacttcctgccccttgaccgttccggcaaccgccgctttatccccgtcatggtgtacccggagcaagccgaggttcacattttagaggacgaagctgcttccagagcctatatcgagcagatgtgggcagaagcgatggagatttaccgaagcggcaggttcaagctggctttcagccccgccatgcagcggtatctcaaagaacaccagcgggattttatgccggaggacaccaaagccggaatgatacaggcgtatcttgataagtacaccgggagcatggtctgttccaagcagctctacaaggaagccttgaaccatgcctttgacgaaccgaagcaatgggaaatccgggaaatcaacgagattatgaaccagtgcatttccggctggcggtacttcccgaacccaagaatgttttcagaatatggcagacaaaagggctgggagcgtgaaaacccggcaacggactccggcaacccgtctgaaaaaacgatggatggttttgtggaggtcacagaacagatggagcttccattctgaaaatgacagcccgttgcaccctctgttgctatcccgttgccgagccggttgccggggaaaaccccttatttccgggcttttctcccttataacaaccaaaacaacagaaaaataaaagaaaagtataaatagtaaccatcgccagattgagattgtttgcaaggtcttttgaagcccgttgccggacttcgttgccgacaccctctgtctggctattttcatgtatggaggataactgcctatggcaaaaaacaaaacagagattcatgtgaccactgtatttgacggggagctggacgcaaccgatgtgttcgtcagcctgatttcccagaaatacggaaagacaaatacgaaagaatatcttgctaaaaagaaagatttgaagtataatgaagatgaggttcaaaagagccagataccgtctggattgtgtgggtaaatggctatgatgaatgaaatggaatacagaacaataggttcggcacttgccaggggttatcgtgcagcggtctattgcagactgtcaaaggacgatgacctgcaaggcgaaagtgccagtatcgcaaaccagcgtgatatgctggaaaaatactgcgaaaagcagggatgggaggttgtggcagtctatcaggacgatggcttcacaggtcttaatatggagcgtcctgatttacagagaatgttgagagccattgagcgcaggcaaatcaaccttgtcatcacgaaagacctcagccgactggggcgtaactatctgcaaaccgggcatttgattgaggactttttcccaagaaacggtgtccgctatatcgccatgaatgacggtatcgacaccctgcgggataacaacgatattgccccgttcaagaatatcctgaacgagatgtacagcaaggatatttccaagaaagtccattcctcttatcttctgaaagcgcagaaaggacagtttaccgggtgtcttgccccgttcgggtatcggaaagacccggaggacaaaaaccatctgctcattgacgaggaaaccgccccgattgtgcggctgattttcggatatgccctaaacggtcatggtccgaactatatccgcagacggctggaggaagaaaaaatcccctgccccacatggtggaaccgggaacgggggtttcgcaatacccgcaccaaatgggaaaagaaagacccggaaaacgggcggtatatgtgggacttctccgttatcaaagaccttttgatgaatcccgtctacaccggggcgattgcttcccagaaaaaggactaccgtttcaaaatcggcacgattggggaaaagaagccggaggactggattgtggtggagggacagcatgaaccgctgattgaccgcatgagctttgacattgtgcagaacaagctgaaatcccgccagcgtccggggcagaccaatgaaatcagcctgtttgccggactgataaaatgcggtgagtgtgggaagtcactgacgatacgctacacaaacgcaaaacatccccagcagatttactcctgcaaaacctacaatgcctttggaaagaaccactgcacccagcaccggattgattatgacaccctttacagccatgtgctgcggaaaatccgggaatgtgccagagccgccctgatggacggggaagcggttgccgaccgcttgaccaatacctgtgaagccgagcagcgggaacagcgggaagcaatggaacgctccctcacaagggacgaggaacggattgaggttctggacaaaatggtaatgcggctttatgaggatatgattgcagggcgtatcagtgaacagaatttcaacaccatgctggaaaagacacagaccgagcaagcggagcttaaagcaaaagtgtccgagggcagaaagcggctgtccgatgaagtccagcttgccaatgacgcaaaacaatgggtggaagccattcaggaatacgccaatatcacagagctggacgcagccaccctcaaccgcttaatcaaagaaatcgtcgtgcatgagcgcattgacgaagataaaacaagacacatttctatcgaaattcattttaatctcaaacccatcccagaggtggaacaggtcactgcctgacctgtcccgccgggacggttctcttaaaaacaccatatagattttttgtacgccgccgcccgccatcgagcagagttttacacctaattgggtataaaacagcttatggcgggcggcggcgttgcccttatcggcatgacccttgtaccgctgctttccggcttgttcggttaagaagcgcgggtaaaggcttatgcagagcatacttgacgcgattaacgaatggataaaggaaatcctcataggagccataaacggtaatctgtcaactatgttcggggacgtaaacgagaaagtcggcactatcgccgcagaggtagggcagaccccgcaagggtggaacgcaaatatattctccatgatacagacccttagtgagaatgtaatcgtacccattgcggggcttgtcattacctacgtcctatgctatgagcttatcagcatggtaacggaaaagaacaatatgcacgacgttgacacttccatgttcttcaagtgggtgttcaaggcgtttgtggcagtctaccttgtgacgcacacctttgacatcactatggcggtgttcgatatggcgcagcacgttgtttccggcgcggcgggggtaatcggcggcagcacagagattgatgttgccgccgcccttgcttccatgcaggacgggcttgacgctatggaaatccccgaactgctcttacttgtcatggaaacaagccttgtgagcttgtgcatgaaaatcatgtccgtactgataaccgttatcctctacgggcgcatgatagagatttacctttactgttcggtatcgcctatcccgtttgcaacaatgacgaaccgggaatgggggcagataggaaacaactacctcaaatccctgttcgctatcggttttcaaggcttcctcattatgatatgcgtcggcatttacgcggttctggtaaacaacatgataatagcggacaatctgcacagcgcgatattctcccttgcagcctataccgttatcctctgtttctccctgttcaaatccggcgcactggcgaagtcgatattctccgcgcattagcggcgtgtcaagggcagggtggagattttcagagcgaagcggcgaaaatacgacccgaccttgacgcggataacccccatataatacgggcgggcaaagggcatagattgacctttgccttgattacccttatgggaagttacagcaacaccaaacccagagaaaggaggttttcacttggcgtatgtacccgtacccaaagacttatccaaagtcaagacaaaagtagcgttcaaccttaccaaacggcagattgtatgttttgcggcggctctcctgttcggcttgccgcttttctttctgctcaaagacagcacaggcacaagccttgcgtctatggctatgattgccgtcatgctgccctgtttcctctttgccatgtatgagaagcatggacagccccttgaagtggtggtgaagaacatcattcagacgaaattcatagcccccaaagaacgaccatacaggacagacaacttttattccgtcttagaacggcagagaaaacttgaaaaggaggtatcagcgattgcaaaaggaaacacgaagaaacagcgcggcgggaagcgcaaagcctaacccgccccgcaagctcacccgcgccgagaaaaagcagattgcggaaatcatcagacaggcaaagggcgacgggaaagcgcacaccgcgcagcagacaatcccttatatccagatgtacccggacggtatctgcaaggttacgggacggaaatactcaaagaccgtcgcctttgaagatattaactatcagcttgcacaggcagacgacaagaccgccatttttgagaactggtgcgacttcctcaactactttgacgcttccgtttcggtgcagctctctttcatcaatcaggggacgcagcgcggcgaagcggaaaaggcggtcaatatcccggcacaggaggacgctttcaattctatccgcacagaataccgggatatgctgaaaaaccagcttgcaaagggcaacaacgggcttgtcaaagcaaaatatatcacctttgccattgaagccgacagtctgggcgcggcgaaatcccgccttgcccgtatcgaaacggacgtactcaacaactttaagctcttgggcgtgtctgcccgccccatgacaggctatgaacgccttaaaatgctgcatggcattttccacccggagggcgggcagtttgcctttgatttttcatggcttgccccgtccgggctttccacaaaggactttatcgccccgtcctctttccgttttggcgaggggcggtatttccgcatggggcgcaaaatcggcgcggtttcattccttgaaatccttgcgccggaattaaacgaccgtatcttatctgacattctggacttggaaacgggcgttatcgtcaatctgcatatccacagtatcgaccagaccgaagccataaagacaatcaagcggaaaatcaccgaccttgacaaaatgaaaatcgaagaacagaaaaaggcggtgcgctccggctacgacatggacattcgtgcgactcgttcctgaacaaagccttcgtggttgaaggacaaaatcaggcattaacaaaagaacgaaaatttcaaatgttaggagaactaacaatccgagaggtggaatgatggggtaacgccctgaaacgcccccttaatactccgactggcatttcaacagaaatgtgacttgtcagaagctcggtgaagtcggctgagagtagccgtatggattgctggataaataccagcctcacgaaagctgtccagaggtggacggtgctacctataggccggaggtctacaaaatacccaaggtcagaatgtttgaaatatgactgacgaaaaccgcgaatgtaagggtctataccatgacggcatagaaatgtgccggtagcgttaatcgctaatcagtgtggtggagtaaaaattgatgttatgaaacaccatagcacgttacaggcgtgttcaagctgacaggcttaaagcggagacctaaaggtatatgtaaagataggattgttggaacgaggaaaggcagtaggcttccaccattaggaagtaagcagacgaatcatataagctgctgtactactgctgaaaagcagaggtcgaaccgatgatgttttctgcgaaaaagaggaaaacggaggaatggcctcaagtcagtcaaacagacaacttagcacttagtcgcaattaggattgcgagtatgacaaaaagaagtcactcgccgtaaaggagagtgatgcctgatgccaaatgagaagaaaccaaaaacaaaatacgtggagtatctccgccatgctgaatactacgatatgcagagtacctttgatgagctgtatgccagaagtcaagccggagaaatctttgacggcctgatggatgtgatactttcgagagaaaatatcctattggcctatcggaacatcaaatccaataccgggagttttacaccggggacggataagctgaaaatttctgatattggtaaacttaccgctgacgaagtaacagcgagggtacgtagaatcgtaaagggaggtaaaaacggctacaccccaagaagcgtgagacgcaaagaaatccctaagccaaacgggagtaccagacctctgggaatcccttgtatatgggatagattggtacagcaatgtatcaagcaagtcatggagcctatctgcgaagccagatttagcaataacagctatggattccgtccgaatcggtcggttgaaaatgcgatagcggcaatctacaggcttatgcagaggtcaggactttactatgttgtggagtttgatattaagggcttctttgacaatgtagaccattcaaagctgataaaacagttatggtcacttaatattcgggataaagaattgctctatgtaatccgcaggattctcaaagcaccaatcctcatgccggatggccatatagaacacccagcaaagggaacgccgcagggcggcattatttcaccactgctggcaaatgtggttctgaatgaacttgaccattggatagaaagccagtggcagtgcaacccggtaacggaaaactactcctacagggaaaatgcgacgggctgtccgatacaaagccatgcgtatcgggcaatgcggaatacaaggttgaaagaaatgtatatcgtcagatatgcggatgattttcggattctttgcaggacgaaagaacaggcagaccggacgctgattgcggtaacgcattggctgaaagaacgcttacgtcttgatgtttcgccagagaaaacgagagttgttgacaccagacggagctattctgaatttctcggattcaaaatcagactgcacaaaaaggggaaaaagtatgtcgttcaatcgcacatgtgcgataaagcctatagaaaggtcaaggccaacctgacaaagcaggtcgggaacatcaaatttccaagaaaagaccgtggagaggccggagaagtacggctgtttaactcaatggttatgggaatccagaattattatcagttagccacagacatcagcattgattgcggtgatattggcagaactgttaatatagtccttaaaaacaggctgaaatcaggaaaaacgcaccgactaaaagaagaaggtcgagaccttacaaaaatggagctccaaagatatgggaaatcggaacagctaagatatatagcacaatccaaagaaccgatttatccgataagctatgttcaatgcacaaatccaatgaatttgcggcgaaaagtatgcgcctacacagcgacaggcagaagtgcaatccatgacgatttacggataaacacttccttactgttacagcttatgagagcgcctacataccgccgtagtgcagaatatgcggacaaccgtatttcactattctccgctcaatgggggaaatgtgcaataacgggaaaggaatttcagtgtgtttcagaaatccactgtcaccataaaacaccaaagggtaatggtggcagtgacaagtatgaaaatctggtattggtgcttgcaccagtacacgaactgatacacgcagtcaatgaggatactatttgttcttatctctccgctcttaaattggacgcttcacaacttatgaagctaaacagactgcgaattctggcaaatcggaaacctattgatttggagaacctaaatcttacgaataattctcataatggtatgactaaggagactaagaaaactgtttgattgatggaacgccggatgcggtgaaagtcgcatgtccggtgtgaagcgggggaaaagctggagataacttcaaaggcttacctatcgctattcccgtccgaccttgccacgttcggcagcgaagcgaagaacctcttacaggacttgcagagccggaatgaaagaatgttcctcttgacgttccttgtggtgaacatggcggacacgaagcggaaactggaaaatgacgtatttgcggcggcgggcattgcacagaagaacaactgcgccttaacccgccttgactaccaacaggaagcggggcttatgtcctctgtaccgcttggggagaaccttatccccattcaaagagggcttaccacgtcaagcaccgctatctttatcccctttatcacacaggagcttttccagacgggcgcggctttgtactacggcttaaacgccctgtctaacaacatgatactctgcgaccgcaagcagctaaagaaccccaacggcttaatcttgggtacgccgggaagcgggaaatcctttgtcgccaaacgggaaatgacaaacgctttcctcattaccgacgacgacataattatctgcgacccggaagcagagtatttttcccttgtgcagcggcttgacgggcaagtgatacgcttgtcgcctacgggcaagggcattgacgggaagccccagtatgtgaaccctatggatattaacctcaactattccgaggacgacagcccccttgcgctgaaatccgactttatcctctccctctgcgagcttgtcataggcggcaaggagggcttgcagcccgtcgataagaccgtcattgaccgcgccgttaggaacgtgtaccgccctttccttgcagaccccgccccggagaaaatgccgattttgggcgacctctacgacgagcttttgaagcagccggagccggaagcggcgcgtattgcggcggcgttggagctgtatgtttccgggagccttaacgtctttaaccacaggacgaatgtagagctttcaaaccgccttgtctgctttgacatcaagcagcttgggaagcagctcaaaaaattaggtatgctcattgtgcaggaccaggtatggaaccgcgtcaccgtcaaccgggcagaaaggaaatccacccggtattttatggacgaatttcatcttctcttgaaagagaaacagaccgccgcctattccgttgaaatctggaagcgtttcagaaaatggggcggcatacccacagccattacgcagaacgtcaaggtgcgcccagatagggcgttgtgcaaagcagtttaaggtactgccgcacacggcagtgtgcgaaacaatctgccttaccgactaaggagaaatcctttacgggaacagcgcatggcagaaaaaggaatagtcaccaaaggacttaggtgcgactgtttcctaatgttaagaagatatgaggataagattgggtttatcgaatgtaaggttccagttcctgttttttgcaggtgtgggaaaagtcctgtaacccatgtcataacgctgtcacgtcatctttcacggcgggacaactgctacacgttatgaaacaggcgtgagaacacgtcataacgaaccgaaagcatatccgacaatcttcattcacctaagcacaacgctaactggggattgcctaagtccggctcattcgccggatatggtaacggaggctccatagtagtccgagaggggtaatgacccttacatggcgaagggagccagttagtaacatctaaaatgtaagaatgaaagggaggagaaacctcaatgaaaccaacatctgaaattttagagcgtattgaaaggtgttccagcgaacacaaagacggcgtattcacaaggctatacagatatttactccgtgaagatatttactacgccgcctatcagaaactttatgcaaacaaaggcgcaacaacacagggtatcgacgacgataccgcagacggtttcagtgacttctatgtaaaagagttaatccagtcactaaaggacggaacctacaaggctaaccctgtaagacgtgggtatattccaaagaaaaacggaaaactccgtccgctgggtatcccgtctttccgtgacaagctcctgcaagaagttgtcagaatgattttggaagctatctatgaacctgtctttgacagtcactcccacggtttcagaccgggcaaaagctgtcataccgcactccgtcagatttcttctgacttcacaggcgtggtttggtttatcgagggtgatattcagggttgttttgataacatcaatcacgaaaaactgattgagattttgagcaggaaaatcaaagacagtcgctttctgaacatcattcgccagtttttgaaagctgggtatatcgagaattggaagtataacgccacttacagcggttctccgcagggtggtatctgttcaccgatacttgcaaatatctatctgaatgagctggacaagaagtttcgggaaatcgcagaacgctttgataaaccgaggtccgcatatcagacaccggaatatcatacggcaagcaaagaattaaaaaggctgtcctactggattgaccataccgataatgaagcggaaagacaagaactgattgaccagcataaagcgcagaagaaagctatgagaaatctgccctgcaaacccgccgacaataagaaatttacttttgtccgctatgcggacgactggctggcaggtgtgtgcggcacaaaagcggaatgtgaagaattaaaaaccgaaatcgctgaatttctaagcacagagttgaaattgaccttgagtgaagaaaagacgctgataacgcacagctccgaaaaagtccgtttcattggctatgatatttgcgtccgcagaaatcaggaggtcaaaggtcacagaatgaaaaacgggacgtggagaaaatcccgtaccctgcacatgaaagttgcccttactattccccatacggaaaagattgagaaatttatgtttgcaaagaaagtcattcgccaaaaggagaatggggagttccagccgatacacagagccggacttctcaaccttgcggattatgagattgtggagcagtacaatgccgaagcaagaggactatgcaactattacaatctggcctgtgactatcacacgctggactacttctgctatctcatggagtatagctgcttaaagacgattgccaacaagcataaaaccagtatccgcaaaatcatccgccagcacaaagacgggaaaacgtggtctgttccttatgaaaccaaagctgggacaaaacgtgtacgccctgttaaaatcgcagattgtaagcgtggcgaagcgagtgacatcatctatcagagaaagaaatttagctggaaaaccactatcagacaacggcttaatgccagagtttgtgaactatgtgggtgtaaagaagccgacttgtacgaggttcacgttatacggaacctaaacgagttggggaattctgattgggaaaccgtgatgaaaaagaagcggcggaaaacacttgttgtttgtagcaagtgccatgaaagaatacacaaacactaatcaatacgtcaattactaatggggagccggatacttcgagaggagtaagtccggttccgagggagggtgtaggaaacctgccgccaacggcggcaagacgcctttaccctaccctacgatttgcttgcttcccgcgaagtggagaatatctttgaaaactctgattttgtcctcatgctcaatcaggcggcgggcgaccgggctatccttgcaaagcagctcaacatctccccgcagcagatgaagtatgtcacccacaccgaagcgggcgaggggcttatcttctacgggaacgtggtgctgccctttgtagaccgcttcccgaaagacaccgagctttaccgggtaatgacgacaaagccggaggaagtgggcgaagcatgaacgggctgaaaactgacaccatcatcaaccgggacgcgctctatgccttgcgggagcttccagaggaaagcgtacactgttgcgtcacaagcccgccctactatgcgcttagggattatgggcttgatatgcagattgggcgggaggacacgccggagcagtacattgacaggctgaccgaggttttccgcgagctgcgccgggtactgcgttctgacggtacgctctggctgaatatcgcggacacctactgcggcacaggaaataaaggctaccatgcagacccgaagaacccgaaaggcagaaacggacagcagattgcaagaaacaaccgcgtttccggctgcaaacaaaaggacttaatcggtattccttggcttttagcctttgccctacgcgctgacgggtggtatttacggagcgacattatctggcagaaagaaaaccccatgccggagagcgtgaaagaccgccctacccgctgctatgaacatatctttctgcttacgaagtcaaagaagtatttttatgacgcagccgccatagccgagccgttagcccccacaacggcggcgcggtaccgcaccgggcgcagcgcgggacagaaatatgcggacgaaatacccggacaggggaaagtacaggggcttaaccgggcgcgaagcggcagctactacgacgaagccctcatgccgaccatgcggaacaggcgggacgtgtggcttatcaataccgttccctacaagggcgggcatttcgccgcgttcccgccaaaacttgccgaaacctgtatcaaggcgggctgtccgaaaggcggtgttgtgcttgacccctttttcggcagcggcacgacgggggcagccgcaaagcagcttcacaggcattatataggcattgagataaacgccgagtattgcgcccttgcaagggcgcggattggagggacagacacataaaacaatataaagcgcgtgaaaaagtcacgcagaaaatgacccgcgagggggctgtcgaggtaaacgccgccaccgggaaaaagaaacgtatcagcaagcggataagggacgcggactttgcaaagaccgaagcaccgcagccgccggaacaggcagcgcagaccataccgggcggcgcagctcccgcgcccacagccgccgcgccgccgcttccccatgcgccgggggcagaacgggaacaggacaccgccgcagccgagcgcgtcttggagcgtatcgacggggcgcgtaccagaaaggcgagcaaaaaggcggcgaggaaagcacaggcagaagccacagcaaaagaaaaatcttcccgcttgcagtttaccgacgaggaacgggcaacgccggagcttgaaaggtatatccgaaaatcggacaaagcagccgaccgtctggacgcggcaaaggcggctatccccaaagaaaagaaacttgtacgggagcgcacctttgatgaagccaccgggaaaggcaagacccgcctacattttgaggaacaggaaaagcccataggaaagaataagccccacaataacccgctatcccgccccgcacaggaagcgggtattttcgtccacaacaagatacattccgttgaaaaggacaattccggcgttgagggggcgcacaaatccgaagaactggcagagcgcggcgcaaagtacgggacgcggaaagtcaaggagggctaccgcagccacaagctcaaaccctaccgggcggcggcaaaggcagagaaagcggcgttcaaggcgaatgtggatttccagtaccacaaagccctgcatgacaatccgcagattgcgggcaatcccctttcccgcttcatgcagaagcagcaaatcaagcggcagtatgcaaaggcggcaaggaaaggcggtgcaaaaacggcgcagaaagccgcagagaacacccgcaaagcggcaaaaaagaccgccgaggaaacaaaaaaggcaatcgcttttgtagggcggcacccggcgggcgtatgtatcgccattgccgcgctgctcttattcatcatggtatcggcggggctttcctcttgcggctccatgttctccggcttgatgaacggcatacttgggacttcctacacgtcggaggacagcgaccttgtggcgacggaaaataattatgccgcaaaggaaaacgagcttcagcagcagattgacaatatcgaaagcacccaccccggctatgacgaataccgctatgaccttgacagtatcgggcataacccccatgagttagcgtcctacctcaccgcccttttacagacctataccccgcagagcgcacaggcagagctaaaccgcgtctttgccatgcagtacactttgacgctgacagaagaaacggaaatccgctaccgcacagaaacaagcacagacccggaaacaggggaaacgaccaccgaggaagtaccctacgagtaccatatcctcaacgtgaagctgacgaacaagcccatttccgagattgcggaggaacttctaacgccacagcagcttgaaatgtaccgcgtctatctggaaacaagcggaaacaaaccgctgattttcggcggcggctcccccgatatgggcgcgtccgaggatttaagcggcgtacagcttgtaaacggcacacgccccggcaacaccgccgttgtagaccttgcgaagcggcaagtcggcaacgtgggcgggcgacccttttggagctggtacggatttaacagccgcgtggaatggtgcgcctgtttcgtttcatggtgctacaatcaagccggaaagagcgagccgcgctttgccgggtgccagtcacagggcgtaccctggttccagtcacgcgggcaatggggcgcgaggggctatgagaatatcgcccccggcgacgctatctttttcgactgggacggggacgggagcgcagaccatgtggggcttgttatcggaacggacggggagcgcgtctataccgtcgagggcaattccggcgacgcctgcaagataaagagctaccccgtcaattactcctgtatcaaaggctatgggctgatgaactggaattaacatatttttgagcaaagaaaggagaaatttattgatggctatgaacaaaattgaacgtatcgacaaagagattgcaaagacccgcgagaaaatcaccgagtaccagaacagattaagggggcttgaagcgcagaaaaccgaagcggaaaacctgcaaatcgtacagcttgtgcgctccatgcgcctttccccgcatgagctttccgctatgctttccggcggcggtattccgggcatggaagccgcgccgggctaccccgcagaacccgcagaccacgacaccgaagaaatggaggacaccgagaatgaataagaaaatccttagaaccttgaccgcactctgcgccgccctcatgctgacgggcggcttttccgtcaccgcctttgcacagaccccggagggacaggacgcgaccgacgacagcggcgttgtctatgaggaacccgaaaaggaagaaccccttaccccggacgggaacgcgacccttgtagacgatttcggcggcaacaagcagcttatcacagtgacgaccaaaaacggcaattacttttatatccttatcgaccgggacgacgagggcgaggacaccgtacatttccttaatcaagtggacgaagccgaccttatggcactcatggaggacggaagcaccgaagcagccccgcccgccgtttgcagttgcaccgataaatgcgaagccggaaaggtaaatgtgagctgccctgtctgcaaggacaacatgaccgcttgcagcggcaaggaagcggagccggaaaccgagaaaccaacagagcagcccaaagagaaaggcaatacaggcgggcttgtgcttttccttgtcgtggcacttcttggcggcgggggcgcgttctattattttaagtttatgaagccaaagcagaacgtcaagggcgacaccgaccttgaagatttcgattttgacgattacgacgaggacgagggggacgggctttctgatgaagaacaggaggacgaggaagcatgacgctttttaccgaaaaccctttagaaaaaatgatggtacaaagacccaccgggcggcgtgacagtgcgccgcccgttccaaaatccccggcgtgtatgcgttgcccttataaggcgcaatccccctgtatcggctattgtctgaaacaggcacaggagaagaagcacaccgcgccggaacgctgaaaggaggattttttcatggcatttagacttgtgattgcagaaaagccgagcgtggcgcagactatcgccgccgcgcttggcattaaggggaaacaggacgggtatatcgagggcggcggctacctcatttcatggtgcgtcgggcatttggtacagcttgcggaagctgccgcctacggggagcaatataaaaaatggagttttgacagcttacccattctgccggaggaatggcagtacgccgttgacccggacaaggggaagcaattcaaaaccattaaagagcttatgcaccgcgccgacgtttccgaagtggtaaatgcgtgtgacgcggggcgcgagggtgaattgattttccgctttgtctacgaagtggcgggctgcaagaagcccatgcgccgcttgtggatttcttcaatggaggacggggcgattaaggcgggctttgcttccctcaaagacgggcgggactatggcgcgctctttgcgtccgccctctgccgcgcaaaggctgactggcttatcggcattaacgccacccggcttttctcctgcctgtatggaaagaccttgaacgtggggcgcgtccagaccccgaccttaaaaatgctcaccgaccgggacgcggctatctcccatttccagaaagaaaaatattatcatgttcgccttgatttatccggcgcggacgcggcaagcgaaaggatttcggacaaggcagaagccgacgcgctgaaaggggcttgcgaagcgggaaaggcggtatgcgtttcccttaccagagagaagaaaaccgcagccccgccaaagctctttgaccttacctctttgcagcgggaaacgaaccgcattttcggttacaccgcaaagcagacccttgaccttgcacaatccctttatgaaaagcggctccttacttatccgaggacggacagcagctttcttactgacgacatgggcggcaccgcagcggacattatcgcgctgctttgcgaaaagctcccctttatggcgggcgcggacttcacgccggagattgcaaaggtattagacagcaagaaagtatcagaccaccacgcaatcattcccactatggagcttgcaaaggctgacccggacgcgctgccggaaagcgagaagaatatccttacccttgcgggggcgcgtctgctttttgccaccgccgagccgcatatttatgaagcggttacggcggttttctcatgcgccgggacagacttcaccgcaaggggaaagaccgtacttgcggagggttggaaagagcttgaacgcagataccgggcgacgctgaaagataagcccgaagcagaggacggggaaaatgagggcgtgacgctgccggagctttccgagggacagaactttcctaaccccgccgcaaaagtaacggagcataccacaacgccgccgaagccccacagcgaagcgtcgcttctctctgctatggagcgagccgggaacggggacaccgacccggacgcggaacgccgggggcttggcactcccgccacccgcgccgccgtcattgaaaaactggtaaagggcggctttgcagagcgcaaggggaagcagcttatccccacgcagaacggagccgcccttatatcagtcttgccggatatgctcacttccccgcagcttaccgcagaatgggaaaacaatctgacgcagatagcaaagggagccgcagaccccggcgaatttctgtccggcattgaagctatggcgcgggagcttgtgcagacacacgccgcagcactggacgggaaaaaggatttgttccgggaggaaaagccctctgtcggcaaatgcccccgttgcggttcccccgtccatgaggggaagaaaaactattattgcagcaacaaagaatgtgcctttgtcatgtggaagaatgaccgctttttcgaggaacgcaagaccgctttttccgcgaagattgccgccgcgctccttaaatccggcaaagtgaatgtgaagaagctctattccccgaaaacaggcaagacctatgacggaactatcgttctggctgacactggcgggaaatacgtcaactaccgtatcgaagtacagaagaactaaaaacttgaatagcaagcataggaagcgggtacccacttccgtaaatccctgtcctgccgctgacgcgccggacggggattttgcttgttgggaagtttcccaaaccctctaaaaaaatgaaaaaattgttggcataacgcacagcccaccgtagtacggggcgaaccccaaaagcgcggcggtgcgccgccatttcagaaaggagcgaatgaatggaaaagaaaaaaggttactccatgtttgagcgtgacaagttagacccggctgacagtatgcggatagagcgaaatatttattttgaggaacagaccgctgacctttccgggcttaccgccctgcccttagaacagttacaggcattgcgggaagaatacgcggcggctgaacaggcagcttttgaagccttgcaagaacaggcggcggcatgggacgaacaggcgggaaagacccttgccattgacaaagccattgagtatgtgaggacacccgaagctacgcataccgcgaaccagtgggaagctacggactacgggaagcacatcagcaaccgcgtctaccaaatgcgctaccacatatccgagaatacccggtatgacagggaaaaagagaaatccattccctattcgtggacgctttcatggagtatttacaccaacagcccccacaattacggacaggcaaaaatcgccggacaggaaaggaaagtctttgcagacaaggcagctatggaaaaatatctgaatgggcgtatcaaagcctatcagcatttattcaccgaggtatcgccgcctatcccgccagagtatgcagagcatttcaaagtaaacgggcagcttttaccgggctatgctatcgagggcgaggaacgggcgcagcctaccgctgaaaaagcagcccccaccacagcagagccgccacaggacaccgaacagagaaaggagcgtgaaaccataaacgagcagttttcaattcttatcgacagccgcagccgctttgaaacaggcaaaccgggcggcgtgtggcttcccatgccgaccacaacagagcagcttcatgcggctatggaaagcgtcggcattaccgcagacaatccgcaggattttttcatcaacgggtattcttctacggaggactgcccctttgacttgccgctttccgttatccaaagcgcaagcatggacgagctgaattattttggaaaacttctggaaatgcagagtgacggggacaaggataaatttgcggcggcggttacacatggcgagtatgccggaagcatgaaagaccttatcaaccttgcacaaaaccttgactgttactggctctatcccactgtccgcagcgaagaagattacggttattatcttatcgacgaactggacgagctggagcttcccgaagaagcaaagaaatatttcaagtatgaagaatacgggcgggacgcagttagcaaggataaggggcagtttaccgaacagggctatatctataacaatcagaacacctttaccgaatggtatcggggaacggaaaacgagatacccaaagaataccgcgttatgagcttcccacagccggaacgcggcggacaggacaagacctttatggacgcagccgccacagagcagaccgcccgaaccgccgcagagcagccacaggagccgcgcccggttatccctatcgtgctgacgagcgagaagcccgccgagaaattaaaagagattaccgaccgtctggaacagggtattgcggaactctttgacagcgagcgttacaaggaatatctgaaagtcatgtcaaaattccataattacagcttccgaaacaccgtccttatcgccatgcagaagccggacgcttcccttgtggcgggcttttccgcttggaagaacaactttgagcgaaacgtgatgaaagggcaaaagggaattaaaatcattgccccgtcgccctataaaatcaaacaggaaatgcagaaaatcgacccgcacacgcagaagcccataatcggcaaggacgggaagcccgtcaccgaggaaaaggaagtcaccatacccgcctacaaggtggtatccgtctttgacgtttcccagaccgagggaaaggagctgccggacattgccattgacgagctgccgggcgacgttgaccgctacaaggattttttcgcagcccttgaaaagacttcccccgttcctatcgcctttgagaatatcgagggcggctctcatggctactaccacttggaggacaagcgcattgctatcaacgagggcatgagcgaattgcagaccttaaagaccgccattcacgaaatcgcccatgcgaagctgcacgacattgacctcaacgcgccaaaggacgagcagcagccccacattgaccgccgcacccgcgaagtcgaagcggaaagcgtcgcctataccgtctgccaacattacgggcttgacacgtcggactactctttcggctatgtcgccgggtggagtagcgggcgggaattgtccgagctgaaaagctcccttgaaacgatacgcagcgcagccgccgagattatcaattcaatagacgaaaatcttgcggagctgcaaaaggcacaggacaaggagcagaccgccggacaggagcagcccaccagagaggaacaggcagccccgccggagcagccgcagccggaagccccggcaaaggcagatacagccgggaaagagaagccggaagcagccgcaccgggaaaatccggcgcacaggaaaaggcgggtgcagccccgaaagaagcctttaccccggaaacgatttacaaggtgcgccggaacccttacagcgacagccgggaaaacagctacctcttgcaagcctatgtgacacaggagaacgggcgggcgaaaatgggcgacgtgctttatacgggaacgccggagaaatgccgcgagcttatggggcagctcaaaagcggcgagctgaccgagggcgacgtaaagcagctttacgcaaaggcacaggaaacggcgcagaccgccggacaggacaaagacaccttttccatttaccagataaaaggcggggacgaaacaagggatttccgctttgagccttacgaccgcctgcaggcggcggggaatgtggttgacagggcgaactatgagcttgtctattccgcgccccttgcgccggaaacttcccttgaagatatttacacccgtttcaatatcgaccaccccaaagattttaagggacacagcctttccgtttcggacgtggtagtgcttcatcaggacggacaggacgcggcgcatttcgttgacagtgtaggtttccgggaagtgccggagtttttacaggagcagaagcagcttaccccggacgacttggaaacgggcgaaactgtcaaaacaccgagagggactttccatgtaaccgccatgagccgggagcagatagaagccgccggatatggctttcaccaccagtcggacgacggaaagtatctgattatggggaatgggacgcgggcgtttgccgttgccgcagaacaggcgcagcgggacaatcccttgaaaaccgccgagcagaccacagagcagaacgggaacatgattgacggtatcatcaacaacacccccaccgttgacgaactggaagcaaaggtaaaggcgggcgagcagatttcccttgttgacctggctaacgctgtcaaagccgacaaggagcgcggcaagggagcgaagccggaaaagaagccctctatccgggcgcagcttagagccgacaaggaaaaggcacagaagaaaaacgcaaagcagaagtcacaggacttggaaaggagctgacccatgccggaacagagcaaatttgaaaacgtggatttgttcgcttcccttgaagcgattatgaagcagaacacaggcttttaccagagcgacttagacattgacaaagagattatcgcaaaggcggcggcaagcccccacagggaggacaagacccttttgtggttctgccgcccgtccgggacgcactgtttccgggagcgcgacgttttcctcaaagacaccgcgccccacaacacatggcgtttctacatggagcagacaagcgaccgcgttcttgcctatgcaatcgagctgacgggaaaggagcgcgggaaaatcaagggcaatctgtacgaactggactactctaaacattatgagcgcgtcaaggaaaaggagctgcccgccgatacggtgaagctgatttatgagcgaggggaaagggagatacccgccggacggttcttcaacggcaacccagacccgcagcttgggaagtttgaacgctttgaagccctacccaacgacccggacgcgctgcaatcgctcttacaggaagaacggcgcagccgggagcagctttcaccgggggacttcaaggcgcatatcacagccttgcgggacgggctgattgaaacggaagcgcggcgcattgtgcgggaaatgaagcggcattacgagccgaacagcccgaacaagacccatttcatggcagagctttccccggcgttcatgcggcttgcagccacaaaggacactgaccgccttttctccatgctgccctacaagacactttccttttccaaaatcgagggcagacatgggatgtatgcgctgattgacaagggggagaaccgggacagggagataaggaagccccgcccctctatccgggcgcagattaaaacggacaaagcaaagaccgccccgaaaaaggcggcggcgaaaacaaaaaatcacgatttggaggtgtgaacatgacaaaactgaccgtagaggaaacaaaccttttgagcatttacaagaccgggagccgacaggggcttatcgtcgccatgaacgccgcgctgccctttatggacggggaaatgcgggactttgcagcccgtacccttgccaaagtggagcgcatgggcgaagcggagtttgcggtgcttcccatttacgccgctgatgaagcatgagtgggattaagcggctgacaccgccccagagccggaaagtaaatgcgcttgtgcgccggacgtgctgcaactgcgataacgggaactgtatcttactggacgacggggacgagtgcgtatgtccgcagctcatttcctattcgcttctctgcaagtggttccgggttgcggtgcttcccgccgacaagctgctctatgcggagctttaccagaccggggacaggaagaagtgtaccgagtgcggcgcgttctttgcgtcaagctctaacagcgtcaaatactgccccgactgccggaaacgtatcactcgcaggcaggccgccgagcgcatgaggaaaagacgcgcccctgttacgcagtaggcgcggaaaatcccttgatttacagggctttccgggcgtgaaaatcggataggcgatactttatacctttacccccgaaaatggcgttctactgcgtaacattcacgaaaacagcacccataaaaagacagggcgcggaagtcatatactggcttccgcgccctgttctttttttgcctatctgacatttcccttttccatttcttcaagcgggaactgcgggagggcttctatcagcttctttgtgatagactggcgcatatcttcgttgatttcctgtttcgtgcttccgtctggctgtctgaccgctaccgtcgatagcctgtcgatttcgtccttgtagcaatccacgactttctccaccgcccatttctccccggcaacggcggcgcgtatggtttcatattccggcattttctggttttccatgctcaacgctcctctgctttttgatagccctatcatagcacagcggcggggattttgctatccttatccgcgttctgtttccttttcccgttccggctgtctgtctgcctgtaaaatgctgtcaatgttctgcttgataatatcatattcccggactttctttttcaattttccatagtcggcgtaaagggcttctttctgcgcttggagggcttcatactccgattgcagcgcggcgaggttcgggagcttcgcaatgcccgccgctttcagtgaccttacggcggcttcatggaggataattgcctgttcctgtccggcgcggtacttctccctgttccttgccttgcggtatgcgtcatagacaggctttgtcttttgataggtggaaacattcttgataagcaccgccatttccgcaagccgcttttcggcgttcttcaatgcgtctgccgcctgtccgctttccgctgccatttcctcaatccggctgactaaatccgcgtactgctcaatcttatgttccgtcaagaaattcattgttttagctgcctgtttcagattgtggattttcgcccactgttcatagcccttactctgcgctgccttgatactgttctcaatgtcgataagcagcgacacgccgcgctgctctctgggagctttcgccacctttgtccgtctgcccgctatccgttcccttacggcttcctctgtatagtctgcgccgagggttttaaggcgggtgaagcgttcctgtccgggggcgcggcatgatacatatttccccggctttatctcatagcccgccgcctgtaaccgcgttagcaattcctcaaaactggaaacttgggggataagcgcgtcaacagtggttttcagcttgcctttccaacttgtacccgtcttttctgcctggtactccgcatagctctttcccttgctgcccttgccggggacgacaacggacaagccattttcccggcacagcttgtcgctcatgttccgtatgccgtaatagctccttttgttggaattgtatttatggtggtctacaaagttcaccgcgcaaaaaatgatatggttatggacgtgtcctttgtcaatgtgcgtcgtgagtacatactcatgctgcccctttgttaccgcgtcggcaagctgctttccgatttcatgggctttctgataatcgacttcccccggctcaaaggactgtatcagatgaaaggctaaattgttccccttttggagtgcttgcgacagggtatattcaaactcaatatctgccgtttcataggagcaaccgaaagaggacacaagcattttcccgtccgtcttgtccgggttttcgatatagtcaagggctttgcttagagtgcttttaataggcttaatctttgtaaccgccatatctccgcaagcaccccctttatttcctctatgtcctcttggtatgcgttccccgtcgcgtttacgcggcgtgctatctggttgacgttgacaccgattttctgtatctctgcggtcatagcctttatatcggcgtggtctatctgaatgatatacccgtcaatggcaatcttccgcagatacgccgccatgttccgggtgggtacgagcttcattttttccagtattaaatcccgttccgcttccgtcactctgaatttgatttgcactgtccttttgcgtccgtccatgtgttcgctcctttcctttccgttccgagggtttgggacacttcccaacaagcaattttcaaccgacgcgccgcagcgcgggagggcgaaaatacggaagtggtacccgcttcctatgcttgctacgaatgtttttatcctttaggctcttatcacctactacggagaaaaagcgattttgccaaacttacgcaaaagaaaaacgctgcaacctcaaaaaagattacaacgctttctaaatcctgttcagttttaagtcggacattcctattcgccctctttttcgacttcggaaatctcctttgccgttgcggttacaatccgtatgcctgtatcgctcataccgtcaagaagcgcgtcaagctgccgccgctgcgtgttcttctccggcggcgtttctaaaaggaattggtctacggatatatggtaacgctgtatcagctcaaagaatatctgtaaacttgggtgctgccccttgttctcaatgttcgcaaggtagcgcggcgagataaacatttcgtcgcctactttcttgcggctctccttgcatccctcacgcgctgcctttatcgctgccccaaaagccttaaagtcgtatcgtggtactggtctttttgccatagttattcaccctattacattttactgttcccctttcttcttggatatgtctacgtagttctatcagttagccaaaataattcatatatatatatgttgacaacaagctgcttttgtatataatattatataaaagggggggaatgtttatgttacatagcatgcgtattcgataagcattgaaatcaaaaaagatttttcccattttcaatatgggcttttttgtcatgcttattttgcgtatgctatacaacaaaactaacgacgtatagacatagtataaaaactatgccttaattttgttgtagtattatatgtataaatgcaggtcaatgctcatgttgagaattgacctgcatttttttgcgcaaaaggagaaatattatgcttgaaaaatattggataaaatgtccaatttgtaacggaaagacgagggttcaagtattttataatacggtattaagaaattttcctcttttctgccctaaatgtaaattaacgcatatcgttgatgttgaaaaactagaaatcataatcaaaaactctgaaaaacaaactttttaattttgaaaaggaaggatatttaaatgaaacacttacctaaaagtacacctacggaaatattgaatgacccatacggatttacttacaaagaaatgtcggaagtaattggagaggataaagcaagagccttatatacggaattgtataaacagccatttcacaaagaaaatctatcaatatcaacaaaaaaagtctataaaagtagcgatactgaaaagtatgtttatgaattgaaagataacaggtatattgaaacggtttttattaaacggcgagatggtgggactgtttgcgtaagtacgcaagttggttgttctgttggctgtattttttgtgagtccggacgcaatggttttgttcgtaatctaacaccgtctgaaattgtgcagcaggttgtattgatacgtcaaaaagtaaatcgtatcgtttttatgggaatgggagaacctttattcaattacgacaacttgattgcagcaatccatattcttcgagatagaaatggacttaactttccaaccgacggcattaccgtatcaacagttggtccagttaatcaattaaaaaaattgcgcgaagaacatctaaaaattcagttgacaatatctttacatgcagcaacacaggctgcgagaaactgtatcattcctcatatgcacatgtacgctattgaagatgttgttaagcaagcattgtcctattctcaaaggcataatcgaaaagtggtatttgcgtatttgcttttaccaggtataaatgaccgttcctcagatataaggcaacttgcaaaatggtttaagggcaaaaatgttatgattaacgtgctgcaatacaacccgacgagtaattcaaaaattagagcaccacaaaaacaagaaatggttgcgttcaaacatcaattagagcaaacaggacttgaagttaccatgagagtttctcatggtagagagattaaagcagcttgtggacagttagctaatacatataataaagccaaaaaacaacagaaataatttaattaaaagagccagacgcacagacgcagagccgataatatgcagtttgaaatactgctgttatcggctcttttttgattttaatttgtgcccctaataaccatattggagcaaaatcagaactgttgcttgtcgttctttgatttccgcagcagctttgaaaaatcaaagccgccgtttctttttatcttctaatgaaatgacgcggtatcactgttgaaatcggcggctaaaggaggtagccgccatgaagcaaaaagcatatcgacaaaatccgacagttattgacttatcaaaaaaagcccgcccaccaccgggggaaactacgcttatatatatgaactgtctaatcatctggatactgcttacaatgcctatgcgcccgtccgggcttttcggacgggcgcattttgtacgttcaaaaaatttttgaagaaatttcaaaaaatcttcggcgtttttgaaaaacgccgtattgccccgcgaaaaggggggaagcaccaccaactttccaacgagaaaggaggtgagaatgtggaacctaatagcagggagttttacaaacagtgtgcttttcagaagttttgtaatacggtattgcacaatgaagcttgcgacacccatagagaacttcgcagacacaaggcaaaggaagtgaccttttccgacatgaccttagacgaagcgcggcagcttcatacgtttgatgaatatttcaaacgtgaagccgccgaaaccgtctttgagaaagccgggaagaaaatcacgccaaagctgcttcttgaagcaatccgtactttgccggaagaaaagcgcaaagccatattgctgtattacttcgagggaatgaacgataccgagattgcggagctgttcaacacgtcgagaagcacgatacagtacaggcggacaagctcttttgagaaattaagaaaatatctggaggaaaatgctgatgaatgggacgaatggtaacgaacccggctacccggaaaatgcccttgttccttatcctgtcattgtggcagcgacaaagggcgacccggacgccatgaagattgtcttgcagcatttcagcggctacatagcccgcctctccatgcggaagctgtacgacgagcgcgggaacgtctattttggcgtagaccacgacattcgggaacggctgcaagcaaaactgatgatggctgtcctcacctttaaggcagaggaataaaccgcagcggcggcgggacgctttctctctcccccttttccgttccgctgctgacgcggcagcaaagccattctgaaccttgacaaagaaagcggcgcaagataacggcggcgcagcatagggcaaatcggatacgttccttttgcgccgagccatacggcgggtgcgccatgacgctatccgggtgaggttatccccgcccggacagccgagcgaccaacaccgcgccggaaagcaagtgtagcggcttgcgggcgacgacacgcagaatatacaatgatacttccttacagccacagtccgagcgttaagagcgtcgcaggcaatgggtagggcggcatgagaaccatgccggggtgaaattcccatgaggttatgctaataaccgtccgattaaagcctttgttttattgaatagtggacttgctgctattcatagactatattatatgtttgcgaaagaaagggggattttctttgacgcaaaaccaaacgcccgttaccacaacggagcataaaataggaaaagttacttaccttgtatgttcgtccgcaagtgaacgcgcaacggacacactggataaaaagataaaaaaactcattcgcaaagacatggaactgaaccccgcaaacgcccggaaatagggcgtttcttcacattttatacatgacacaggcagcggtatgtggtataatatagacagtacaaataccatgcttgtctgtcgtcggaaaggaggacaaaatgttacagacagacaagattaccgctttatattgcagattgagccaggaagatatgcaagccggggaaagcgagagcatacagaaccaaaaactgattttacaaaagtatgctgacgaacaccactttttcaacacgcgctttttcgtagacgacggattttccggcgtgagctttgagcgtgaggggcttcaagccatgctgcatgaggttgaagccgggaacgtggcgaccgtcataacaaaagacctttcccgtctgggacgtaattatctgaaaaccggggagctgatagagattgtctttcccgaatatgaagtgcgctacattgccattaacgacggtgtagacacagcaagggaagataacgagtttacccctctgcggaactggttcaacgagttttacgcccgcgacacctcaaagaaaatccgggctgtcaaacaggcaaaggcgcagaaaggcgagcgcgtcaacggcgaagctccttacggctaccttatcgacccggataaccgcaatcatctgatacccgacccggaaacggcgcacgtcgtaaaacagatttttgcaatgtatgtacggggcgaccgtatgtgtgaaatccagaactggctgcgggacaatgaaatactgaccgtcggggaactgcgctaccgcaggacagggagcaaacgccacccccgcccacagctcaacgcatggtacaactggccggataagacgctgtacgacattctgacaaggaaagaatatttagggcataccataaccgggaaaacctacaaggtatcttataagtcgaaaaagacgaaaaagaacccggaggaaaaaaggtatttcttccccaacactcacgaacctttgattgatgaagaaacctttgaacttgcacagaagcggattgccacccggcaacgcccgacaaaggttgatgaaattgacctgttttccgggctgctcttttgcggggactgcggctacaaaatgtatgcagtacgcggagccgggacgcttgaacggaaacacgcctacacttgcggcaactaccgcaaccgggcaagaaatgatatgctctgcactacgcattatatccgcaaaagcgtattgaaagaacttgtccttgcagacttgcagcgagtaacgtcttatgtgaaagagcatgaacaggagtttatcgaaacagccaacgagtgcagcgcaaaggcagtacaaaagacgctgacacagcagcggaaagagcttgacaaggcgcagaaccgtattaacgagctgaacatcttattccgcaagctctacgaggacaacgctttagggaaactttcagatgaacaatttgcttttctgacttccggctatgatgaagaaaaaaagacgctgacccggaggattgcggagctgtcacaggaaatcgacaacgccaccgagcgcagcgcggacgtaaaaaggtttgtcgcactggtacgcagatacacagcgattgaagaactgacctacgaaaacgtccatgaatttattgaccgtattcttattcacgaactggataaggaaacgaacacccgcaaaatcgaaatcttttatagctttgtcggcagagttgatacaggtgacaagcctaccgaaagtatctcctatttcagacagataggagccgacgtaaagagttatgctatctaacatacatcaaaaagaggtaagataacaccctctgcaaaaaaggtatcgttatcttacctcaacaaaggtcgtgccggaatagccatcatcaacataaaatcggtaattggtgaagccgttttctttgcaatacctttccagcatttctttctggttttggatactgttgctgtcaccgtcatttgcgtcgtccaccgataaccggcagtacagggcagtcaaagcgtccaggctcaacacgttatggtatgaaagcatttcagtcatatttgccatcattgtgccgcaccccctttcaggagtgcatacaggcgttgatcccgttcacgcttccactggttaagtgaaatatcctggtttaacacatagagcgtcgttccctgggtgtcggcatagtcaataagttcgtcagcaaggaacaaatcacggctgaaccgggaaaaatccatagcagccataatagcatatttccggtcaccagaaaggaatttctgaataccagggcggtcaagagtacggccagaaaagccgctgtccaccaaatagatgatctgctcaggggtaaagccctgttgctccgcccaaagggccagtcgttttttctgtgttagaatccccaaagtattgacttgactgtttgccgaatctacacggcaataaagcgcgatatattcaatttttttattgtccttttcgttcgtctgtaacatcatatcctccaatccgacgaactaaagggcttgggtttatgcctttattataccgcacctttgccgtcttaggaagcactttcgcacattaaagtgttaaatttttattaactgatgtacccaggccagcttcacgttcaatcaatcgcgccattttgtcggcagcagtttctttgctgtcctgattgaagaaagaggacacaacataggtcgtgccctttacccggcgcatcatcacagcgtccggtttcctatctttgtccatttttcacctgctttctataaaaagagggcaccgcgccggattgctccagcgcgggcctcggttatcgttttatttagtaccgtattatctggacttgtcatcgtccatcggctcacccccggtacagtgggaacattcagatcgtgccgtggttatccagccggtagctggcggccctccgcgttcggtgaagtaatgcgttttctactgtgacaggtcacggcaatttccagcccaccacaggccgggtatcagccgccaaataaccgctcagcccctttgatgttatcgtattgacggactgctctgaccagtccgcagggggtcgtggcgtttgcgctatgcgttgctcgctgtcacattcaaaatctgaatgctgatatgaacggattgcccgctgtttgtcaaggtcctgatatagaaaaggtcctccaatccctttcactatataggagggaaagcgggcaaaagttgatagtcaggcggcaagattttcacgaatttttttcagtgcagatttagcggaacgcatgacagccgccttatgacacccctgcattttggcaatttccgagtaagagtaaccgtaggcaaaatgcagaataaatcgctcacgttgctgcggtggaatatcttgcagaacggcctgtatttcccgcagccgttctatacgttcataggtttgttccaaaggctccgtcgccagttcaaaaagcaggcagttgtcaaaggacctcccgtcgatatgtttccggcgctcatatctctggcgttcttcctggcggcggctatcctcataaaccttgtaaacgtccaccgacacttcgacctccagcagattatgatcgatattagtaattgtaatgacatacataggccagccctccatcatgcaacgcggaaaaaagcgacgatctctttcggcgtatgttctgcatgagtatcacagaactgttttggttcgccgcaggcataaggacagcttgcggcagcctgacaaggtggcgtaggggcaggggccgctgtgattaaaacggattccccaggagccagatgaattactttgatggtttttaccataatagaacacctccgatttttgtattagagggcttatccctcttatctatcggagattagagaacctgtaaattaaagggtaacgatacaattttcaaaaaataaatagacaaagacaagggcagtatcgcttggatactgcccttgctttcaactattcgtttagatattccctgagccggtggaacgctctttgaagcagtagcgtaaccgccgccggactacactggaatactgccgcaatttccttgtactgatatccctcccaaaaagcaagtttaatagcctgcttttgccggtcggtcagacgacgcagggctttggctaatttttcattttggacagtatcaataaagtcctcgttaaataattctgtggtaaagtcgttgtggggaaataaagaacgttcttggtaaatgagttcttcactcatactttccagtgagtaacaatgataacgaaatctacggtttgcattgttgattttacgatcttcttcatttatggtcttagtccaatattcgtaatccatttactcctccattccaatcatttttttgaaataattggaatggaggcgatctacacctaaaaacgaaaaggtgggaattggagataaatataaaagcgcgtgccttcggacacgcgcttttatggatagatttaaattaaaaatctttttaatatgcgagtcaattctatatcatcgattggctttgctatatgggcattcataccgcactccagacaatgctgtatgtcatcagaaaaagcatctgcactcatagctataattggaacagatagggcattaggatgattcagtccacggatagcttttgtggcctcataccctgtcatatgcggcatccgtatatccataagaattgcatcgtaatatccctgtggtgatctttggaacttgtccagacagatctggccatcttctgcccaatccagttccacgcctaaatcggaaagtaattctttagcgacttcccagtttagttcattatcctcagcaagcagaatacgacgtccggatagatcgatattgtggttcaatgtctgatcattttctgtttcagcgcccatatactgacgcaaagcatgatacagagtggatttaaaaaggggtttggaaataaaaccactaatacctgcttcacgagcttccgcttcaaattcactccagtcatatgcagaaatcagcaaaatcggcacttcatctcccaaattacgccggatttcttttgcaacttgaatcccattcataccaggtagtttccaatccaatagaatgatttgataatcatctctcttttggtggtgttgggtaaccagttctatcgccttttctccactcaatacccagtcggcattgatgccgatggttttcagcgtgtctatcgctgtcctgcagagtaattcatcatcatcaactaccaacatattccaggaaggaagaaccatatccatttccagtgcaaccgctttttcaaaatcaaatgtaagagaaacctcggtacctttatcaagttcacttgttatattaagggatccttccattgcctccacaatgtactttgtaatcgccattcccaaaccagtgccttgcgttttactaaccctgactccatcagcacggctatagggttcatatattcttttcagaaaatctggcgacataccaattccattatccttgaccttgatatggattcggatatagttttctcctttcggagatttttcttcagagagggatagttgtatcgaacccccctccggtgtatacttcgttgaattcgataaaagatttagcaaaacctgattcaagcgtacaccatcgcaccacacattttctgttaagatattttccacatgtatgtcaaaggtttgcctttttgccttaacctgtggctgcataatattaacaattccttcaacaacttcctttaatgaaatttgttctgttgttaaagttaatttcccactttcaattttagacatatccaaaacatcgttgatcagccctaatagatgtttacttgataatgtaatttttctaaggcaattctgtacctgtttctggtcatctatgtgggctgtggcaatcgcggtcatgccgacaattgcattcatgggtgtacgaatatcatggctcatatttgctaaaaattcgcttttggctttgttcgcttcaagagcagtctgccgggccttctccaattcatacacctgagaacgggttatgaagaaataccgaataaaaatcaatgatagaaaaatcaagatagaagcacaggccaatcctaccataaatatgcgcaggttttccagagcgtccacgtttttgttcaatatactataaggcattaccgatactaaataccactcggaacagggtaatgggttaccatatatttgaagtgtttcaccattcacttcaaatgttgtactatattcgtcatgattctttagtgcagcaccaaattctttaatagaattttctacagatagctcatttgctgtagcattaagctgcttttgtagttgttcaaagaaataccacaactcagtgttgtcgttctgtattacaaaactaccgtctggcctgataatatgataatatatcagctgctcttcattctctaaggaaaggaaatcaatgatgtactccagtgggacggctgctaccagtccagtgctcatactgccatcctgcatagggtaatcagtggcatcaacgccaaacaataccactatatttccggcagaatcactacctaaagcgactctttgttctcctcgtactaatgcttctacaaagggggctgggttcagtggttgtattgattgtccataaagagtctgaaaatctccctcagtagaacaaagtgctaaatagtcaaagttcctgaccttcgtcctgtaaacaagttcctcatataacttttctttttcgttattatctactgagacaacagaaacaatgccgctgacctgatcaaaacgtaattgaatgacagtttgaaagtgtctggacatttgttcgttcattccagacatataaatctgagcaacttcattaatagccttgttgctttttcggctcatataaattccgagcatactgaaaaccataatactaaagacaattaacccaataaaactgcctattagaaaatgtgttacagaatgcttttttttactgtttcccattgatgttattcctccctggaattcttaaaatctctaataacattgatggtttcatagtaatcctctgataatttcggcatcatatcgatagccttatcccaatcgttttcttttaatgcattagttaccaaactactactttcaaacaatctggtaaatgaaagattttgacaaattcctttgagtgtatgaacggcccttagagcctcttcatagtccttattctccacagacgcttcaaacaaatgaaagcttttatcatccaggaatttatacataaatttctgaacgatttgctcacgacgcaatctgcccagcacttcatcaaaatcgccgccaaattttatataacaatcttttagattcataatcacgattcctcctttttaaatgctgtctgcgctgcccaccatctcgtccagaaaactaatggtcacctgattttttgctttttttgattgatacatcatagtgtctgcaactttgaacagtttttctgcggttccacttccatatgccccacctatgcttacagacatatgtagttcgggatgtccatcaattatcagactatcaacagaatgtctgatcctctccagttttttctcaaatatctcttggggcatactaaaaaagatgattacaaattcatcgccgccataacggataactgcatctgtttttcgcacacaggataaaacagtttgtgcaatgctctgcaatatgatatcgccaacatcgtggccataattatcattgatgtacttaaaatcatctacatctattacggccattgcctgaatatcatctgtgccttgaaaatgctcgtcataatagcggcgattgtaaatactggttaaggaatcaatatataataagtgcagttgctgctgtttgcgagacaaggcggtgtattttttacaggaaaacagcctatcgtagtctattttatttcttatatcctgaatatttttagcctcttgttcctgagaggcagccattagttcgtcttcaagtgtatcggcaatttcttgcagacatagtaaaagagaaggattaaatgcaccgcattgtccttctaaaatcatttttaaagcttcttcatgtgaataagctttcttatagcagcgctcactggtcaaggcatcatatacatcggccagcgcaactacctgagcggcaatgggaatttcttctccctttaatccgtccggataaccattgccatcatacctttcgtggtgccatcggcagatctcagaagccactttaataagcggattttcgcgctgctctatggacaggtctaatagcatgttagcaccgatcactgagtgcgtttttatcacttcaaattcctctgccgtaagtcggctgggtttatttaatattgcatctgaaattgagattttcccaatatcgtgcagcgcagaagcagtgctgatcaaagaaatatctgctttagacaaaggatattgatctgtcagctgaaccaactgcttcagcaaatattttgtaattgtatttacatgcaggatatgtaggccgctctctccattacggaattccacaatatgagacagaattgagatcatcagcttactattcttttcctgctcgtgaaattgttctgcaataattttttcaaggcgctgctgccttgcgtataaaaacatcgtattagaaattcgacgctggacaatggttgaatcaaaaggtcggctgatatagtcaaaagcccctaaatcataggccctctttatattagcaggagtgtcatcagcagaaatcataataacagcgaaggtgtcattccaatggtatttgtttatgtaagctaatacttcaaatccgtccatttcaggcatcataatgtccagaagcaaaagggagaaatctgctctttgctttgaaaggagagaaattgcttccacaccattctcagcctctaccacatcatagtgctcttccaaaatatctatcaaaagagctcggttcatttctgaatcgtccacaattaaaattttttgtttatccatgatacttaaactctttcctattgatttgcattttcattataaatgtcatccatatatactggcaatatctatattggtaaggtgtgcaaataggtgagcgttttttgtgctgacaaaatagacacaccatgatataatccagacagcaaggaggcaagttatgaaaccacaagagacaaaatttgaatttgtatataatgaaattaagcagtgtattttagatggacagatacctcatggaaatgccttgccatcttcaaggatgtattgcgaacaattccatgttagcagatatacgattaatcgtgttttcgaagcattgagggcggaaggactggttgatattcagcctcgccttgcgccgattgttgtttcaaaaaaagatacctgtagttcatcaaatattgttttggagattctaaagcaaaaggaaagcattttacaggtatatcagacttttgctctaatactgccttcccttatggtttttgctttgcaggggtgtgatgtggagataatgccccactataagcaggctatgaaagcattgcgtttgggacatgcccccggtgtatggcgttccttttctaaattaggatatgatatattgagaataggtggtaattccctattcagcgaactctactctacgtttggcctttataataagcttgcattttttacagaagagtgtacttatttctctaaatactttttacaggggcctttatctgcaaccagtgttattgacatattaaagggcgatgatccacttacgaagtatgaccagttatcaaatatgtatcaaaaacttgcggattccattgagaatacgttaaattacctgtcagatagcactaccaaatgtcctgcacaaactggtttgaagttctcgtggaatcccatgcgtggtcaggattattgttactcaaaaattgttgatgacttgaatctaaaaatcggtcttggagagtattctgttggaatgtttcttccatatgaaaaacaactggccaaccagtatgaggtctctatatcgacggtcagaaaggcattatcagaactcgagcaaagaggtttcgtaaagacattaaatggtaaaggtactatagtgatagaaccggatgatacgaaacttcatcagctggctcttaattccggatatgtagaaaaagcactacgttaccttcacgctttgcagttaatggtactaattattcgtcctgccgctttagctgctgctccacagtttactaaagaagaactggacgagttggcagatagatttacttcttctgactctatttatttgtcggatattttgaaagccataatgagaaataccacgttagaacctttatatgttatattgtctgaaaccaatcatcttcttgaatggggacaccattttgcttattatccgtccaagaaacatacactttcacatctcaacaagcaagttattcttgcgcttcaacagttaagggaaggtaatgcagattcctttgcggatggcatagcagattgttatcgttacaatttgagtcgtatgaagaagcatatggtagaaaaacataaattttatcatgtagctaatattcgggttccagaaaaatattagttagcaagcaatggaaagggatatccttttgcccgttttcacttcgttctcccgaccaaaaggctacccctttccgcttgttggggagttccccaagcccccggcccaacacagaaatgtgtgggccgaacaccatgcggagcatggtggctgccgcgccctggcggacgcttaaagagcaaggacatagcaaaagccgggaacggtgtcaggggcgcgccgtggcgcgttcattttacccttgacaccgttcccggcttttgcttttgggtagacaaggcggtaaaaccgcagtgcggctttaccggccctgttcctgatttttctctttttcctgttcgtagtcctgtacctgctcaatacgcagaagcgcgtctacatttgccttgactgtctgcaattcctggctttctttccgcaagcgtttgaaatcctcataagctgttttcttcttagcgagcaagtcagcatattccgcctgcaaaattttaaccgtgggcagcttctttgtgcctaaatcgttaaaggcccgttttgcagcttcatgtaacagcagatccgcttcatgggcagaacgaaacgccgccttttccctgggactggcctttcggtaggccacataggtatcatgagttttcgcataattgatgatgtgtgttttcagagccgccacctgctcaatacggtgttcatattgcttgatggaagcagacaccttttcaaactccgaagcggtggaagcggcctgggccgccaacacatcgtactctgtaatgtcatgctccgttaggtaattgagcgtccgtgccgcttctttcaggttatgaattttcagccagcgttcatagcctggcccgcgcccctgcaaacggctttgaatatcaagcagcaaattgatacggccatttttttgaagctgtgcagtacgccgacgcgggcgtttttgtggttgtccaatgcggctttttaaggcttcctctgtataatcggttcccagcgttctggttcgggtaaaacgctcctgaccctcaccggataggcggaaactaagaatgttcctggtagtctgaatctcatagccctcccgccgcatggccgccaaaaattcctcatagctggacaccgtaggcaacacccggtcaatcgtccggcgcagcttcgctttccagcttgagccacgcttttcattggcccattctgcataatgctttcctttttcttttggctccttaatgacggataacttatgttcctgacacagccggtcattgatctgccggattgttttgtaggtattccagtaattgttgaatttgtgggtgcagtccaaagtggtactgttaaactcgatgtgacaatgaatgtggtgcttatctatatgagtagctacaatgaattggtgctggccgccggtaaattccaaggcaagctgataccccagccggtttgcttcctccggtgtaatttctcctggccgaaaagattgaattaacagataggaaataacatcttcgtctggatcgcgccgcctcccggtagtggcttcataaatctgcttactgacggtaaattcctgccacgcggtatctgcgctgcactgataggaggataccagcaggccgccctttgttttctcaggatttttgtcgtagtcaagccgatctttcagtaccgccgcgatactgcggccctcactggcatgacgaggttttattttggaaattgccacctgctgaccctcctttcgataaaaagaaccgcagaccagttatgatctgcggttcagtgagagatgttaaatttccatatgtgttttttctcgttttgcttctttcaatatcctgtttacctgttcaaactgctctttagaaacaagtgcttgatggtcaaagagttccacccgttccagggcacactgcttttgtaaagagggagagccaagccgtcgttccaatgttatggttcccgtgtaaatagaattgcgcgataccctccgtacccgctttttccaatccagaagcgagttagaattttctgcctgtactttatcccggtatgccctccgaatatcatcagcaggaaaatcagcaaaaggccgtgccaggattgcccgcaggttttccgccgattgtgggcactcagagagaatgaacgccatatttttaacggacaattcttctgctacatattcctgtatggctgaaaggctaaccagtgggatagcttcctcataagtcaattctgtgttccagcctttatggcgttccattacctctgttaccagttcggccggaggattctgtatatattcctctatcttgtaaaagataaatttcacattctcagccggtagatcatcaactacaagcaggtttttgtcattcactttataaccatatatctgttccttttgcacctgctccattctggcccgtttctcttttagcagagttctaagcctatcggatattttactgtccgctaccatatccgcatatgctttttctatttcatcgtaagatttcatagtcacacctcacctttattttgatctactttaagaacatggacgcggcacccgtttagaatgccgcgcccggtcagcttttttgtatcaaatagatttcagcatgtggttaaagtccgccacccgttccgtcagccaggaggccgccagcggcagtccgtaggggcttaccagccacgccagaaccaggaagccgataaatccgtccacccgtccggcgaacaataccacgatccccagcaggaacaacagaaacgcgacaatgccgagcaccatgccggaaaacaggcagaagaaccggcagaacgctaccagaagcgtcagagccaggacgatggggaacagcaaaatctttattataattctcattcgcgcaacctcctttgcaaacttatttacggatacactataacacattaaagcgatacagtaaaggcagtttttataaattgtccagcttccccagcagggtactgaccgcgccccaaagttccccataccgttcctgcaggtcggccacatcttcctcatagagattgccggtgctgttcacccgtttggcgatctggtttaagttgttagagcagatccgcagcagcgacaccagggctttgaagtcggacatatccacccggacggcataaccgtccaccgccatctttcgcaggtaggcccgctggttgtgaataccaagctgggccatctttttttctatgagttccttttcttcaggtgataccttgaaataaagcgggattgttcgcccgctgtgcggtttcatcagattgccacctccatgtcttttcctttggcgggaggggaagccgtagccgcagattccacgcccaggcgtttgagcatacctttaatggagggctggccgccctgggtatcgctttccagctcctccgcttcccgctggcgcttgcccaccgtttttccgtccatattcagggcaatccgcagcacgttcagccggtcagatttttcggcaagttcctgttcctgggggaatgaccgctgtacctcaatctttgcttcctccatctgtgcggtcaggttttccaggttggcccggttttcctccaaattctctaccatgatgttcagcgcgtgatccaaacgggccatattgcccacggggtcgctgcccaattcaatggtatgggaaaggctgtgcttcatcgtcacctgaaatttttgcgtctgtgtatctgcccataaggtcagcgggaagccccggtattcgcccaggtcaatccgttccgatacatttttcatttgtgtgcaggcttcgatgattgcctgacctgccgccttgcgctccgtgtaaagttccccggccaaagagatagagaagtgatctttatcctgggggtgtgcctgcaagtgggcaatatcttcttccaggcccttgatttgttcctgcctgcgcttgatagcctgggggaaaaattgaattaagcgatcttccagcatataccgctggccctcgtggttggctttcagcagcttcagctttgtcacctgactgtctaaatcggtcatttcaataatgcgcgggtcgccggaagccagggctttgacctctgcgtaggacagggcggcttcgtccacatcctcacaggaacgggagggatttttaccactcataagctggccgataaacttttgcttgttctccaaaatgctccagttataagcgtcaaaagtgttttccgttacatacttgaaaatcttaacaacctcattcagattgccttggcgcagaatccggccctcacgctgttcaatatcagtcggtcattttttgcggacagttcatacatgctatccttttctgttctctgctcctgcgtttgctctcgtttgatttctccctccgtatcttcttggcacaagcaggacaataccttgatgcaccagagcccgggacatattcaacgccgcacaccgtacaatttttagcgggcattgctgcccaccgttttgtaggtatgatatgtaattcatcgacaaagccgatgaatttatagtaaatcttgatttcctgcttcactgttccgtctgccatcttctcacgctccgaaacaagtatcttgtctatgagtgcgtttataactgttgcatccagttcttttaagccttgataatttcggataagggcgaggaagtcacggattccccgtgatttctcgtagctttcattaagagtttccgtcacctctttcagccttgcttcaatttcaagctgctctttctggtatttccccgacatcatctcaaaattccgctcggtaatacgctccatgaccttatcctcgtagagagaggaaaacagcctgtccagttccgcaaggcgtttgttcagcttcttacgttctttctctaatgctttcgccctgctctggtctgtttccgtgagccgcttttctatggccctgaccgccttttcatcattcactgccatatccgcaaaacagttgatgtcggcaagaacggcattgaataaatcccttgcttctatattgtgggcactacactcgcttcttccgtttcttgcataattattacatgaatactgtacacagtcgataatctctgggcgtttcctcctgtgtacgttcattgcccgcagagcacatccgcagtccacacacttgataacgcctgcaaaaatatttacaaatcctcccttgttctgtggaagcctacgacttgtaataagctgttggacaatatcaaattcctcctgcgtgactattccctcatgggtattgggtatcacttcccattcttcgggcagcttagaggggcgtttcttgcttttcatattggcggcaatccgtttgtagcctacaagatttcccgcatatatcgggcttcttaaaatgctcctcacgctgttcccactccaaatatagcgtttgtcctcgttcccctcaaaatgacgttcaaagcctgtttcgccacgctccgccgcataagcggcagggcgtaggatatgctgtttattaagatgtctgcaaattttggcaactccattcccttttaatgcaaggtcgaatatctcttttacaacatgtgccactttatcatctatcagcagatggttgtggtcggcagggtctttgatatagccataaggggcggtagttcccatgaatttcccctgttgaaacctcgcccgatatgccgattttatcttaacagatatgtcagcggcatacatttcgtttaaaatgttgcggaaaggcgtgatgtccatagcagatttattcaaggtatctacgccgtcattgaccgctatatacctcacgttatgctctgggaagaaaacttccagatataacccacaatcaagatagtttctccccagacgggataaatctttcgtaatcacgcagtttatcagaccgctttcaatgtcttttatcatattctggaaacttggtctttggaaatttgtaccagaataaccatcgtccacatacgtttttgctatgtgccatccctgctttttcacataatccgtgaggatggatttctgtgtcgcaatgctcgcactctcgttatccgtaccatcgtctttagataagcggcaataaatgccgactaaatagattttcttttcttctttgattcctgccatactgtaaaacctccgtatctgtcctatctgttttcatgtcccattgcgtacattctaagcggacagcccctcattgtcgaaggtgtcgccctcggcaatcttcttccgaatatcctcggagataatcgggacaaacgcttctgtaacggtctgtgtgccgacatattcacggctgattatcatctgcactggtgcttttggcacgatacgctttctctttttatctgctttcttatcctcgcccatacttaaatcttcctttccagacagggcagggaagagtttggaaatgtccccgccctgccaatcagataccattaatcctcgctgtttaattctttctgtaatgctttaaggagtgccgccgcttcatcagcgttcagcgtgattcccttgccgcacttttcacggttcggggaaaagctgcggatgtcatacttcggctctttcccattccatgaaatgagattgatttcctttgtgtagccactgtcgcccgtagacaatactgcgatttcctttacgatttcatactggatttctctcattctccatacctcaactctctgtatttacttcccgaaaaaagaagattagcggctgtcacggttgcgtttcctctgcaactcacgctccaaaagtttgatgatggtttcctccatctgcttcggcgttgtgttcttcggaaagtattttttcagcttgcttgtgttgattttcaaggtttctttctggttgcccttttcctccgtcataatcgcaaatatcgtatccatgtcaagccgcccgctctggcttaactgtttcatccgctgtgcctgtgagagtgagggcgttgcttcttcgctctccatcgtggcaaagaggttttcctgctcgtctttcttcaagaaggacagttccaccgcaggcgtgagggcgattttcccctcgtccaccatctgcaaaatcggcggtatcagttccgtcaggcggataaaacgctgcacggtcatcctgcccacgccgaagccctgtgccaccttgtcgtccgtccgcaacttcgtcacaacttgtgacgaggttaagtctgtgcggaaaccctgccgcttcatggcttcggatttcatcttgtaagcaaacgcccgctccgatggcaggatattctcacgctgcaaattgctgtctacaagggtgatgatggctcggtcacggtctaagggcaggacaaacgcaggcacggtatttatccctgcaagttcagaagcacggacacgccgctgtcctgcaatcacttcataaccgtccccgtcctctttcgggcgtgtgattatcggcgtgacaatgccaaattccttgatgctttccgctaactctgacagtgtttcatcttctgccacatgaaacggattgtcggggaacgggtacaagtctttggtctttaacaccttaaaatcctgtttcttcattcacatatctacctttctttcgctctgcttctatgatttttctgcaattcttccaacacttcgggcggtatttttgacagcagccgccccatctgctcgttggttctctgcaattcaaatatcttctgattcgctttctgcacctttagttcctgctcgtacttttcatcacgcatacgccccgcatagtctgattcctgcccaattctctctttcaaactgtcgatatacgcctgctgtttcccgatttccttagagaatttctccacgtctggcagccatgcagagagtaaatctaacgctttatcccttttcttccctgcgttaaaggcgttgatgtcggatagggcagacacgatttcttcatactgtttatcaagcctgccgcctaatttatagagccatgtggggacgtgtttccgcttggtttccattgaggactgcccccgttcaagctgattccaccgtgaggacatccgctcatggtaggcggtctgccactcggataatgatttctggttgcctaagatagctttcgctgacagcttattgtctggcgtaatcggcacaaagcagaggtgcatatggggcgttctctcgtccatatggacgacagcggagaggatattctgctttccaacacgctccgaaatgaagtcaagagccgtctggaaatacgctttttgttcttcgggcggtaactggttcataaattctggtgaagctgtgatgagcgtttccaccatcatcacgctgtctttccttgtcctgcaccccgcttcggctaccatgcggttaatctctttcttgtaggtgtactttggtggtgctatgagatggtaattgtttttagagcgttccatatctatatctgggttgcttttgtaggcttctttcttccgctcgttgtggcgttcacaagccgcaacgccgcccgcttttcgtttctggaaacgcaggattgcataaggcataggcggattcctcctttctttcggcgggtgaccgtcctttggggtgacagcggtgacggtggtgacagcagttttgggataccccctgccgactgccgcaactgtcaccctcaccccctgcatgacggtcatgtcgatgatgacggtgtttttgggatacccccctcgcaagagccgtcaccgtcatgccgccattcttttatccgaagccgtaaggcgtaggatagcagggcacagccctgccttaagggagtccagagggaacgtctggcacacgactttgcagggcaaagtgtagtgtgttacaccctgtaaacgcagtcggaaaaatcggaatgatttttctgaccgcaggggtggttttacacgaccgaaaagggcgagtaaatctcacgcctgcattttgcgtttacggggtgttctcccgtagggatgacagcggcagggtatcctaaaatcactgtcaccaccgtcactgctgtcacccgcagggcagagccgccagctttacatggctttaagcgtcaatgacagtaacaggggggtatcctaatatcgctgtcaccaccatcaccgctgtcacccgccctccttgcaagggcaatccgcctgccgtctttcctgcggctgtactggtagcagatacggttctcgcttaaaaatgtggtgcggtattcattcagccatttcgtaatcaccgtgggtatggtttccgtttcccccatagcggctaacagttccgttgccgtgcctatccattcttccttatccctcataaaatccaccaaccgaaaaaggacatctggtatcgtttctttcgcaagctgctcctgcgttttccgctccacaagctcccaacggcaatcacggaaacgcagcgtgtattcctgataaggcgtgtccctgcccgtcacatacagcttggcggtgtcagacgcacgtttctccttttccagaacaaaggtagcgtccgcactccccgttaatcctgtcgtcccagacaccttgttgaacacgtcgctgtcattctgctttcggatgtggtgtacgacaatgaccgccagagagtgcctgtcggcaaagtctttgatgagggagatgtccccatagtcgcttgcataggcattgtcttttgaagctgtacggactttctgcaaggtatcaatgacaatgagcctgctgtctgggtaatctttcagataatcttcaagctgcacgataagaccgtctgacagcttgcagcttgccacggcaaagtggagccgcccgcttgcttcgtccgtcaaacgaaataacctgtcctgtatgcggcagaacgtgtcctcaaggcagaggtaaagcacatcgccctccattgtcggcatatcccataaagggattccctgcgacacgcataagcatagcttcagcatgagccagcttttgcctatcttctgtgagccgcagaacagcgataagcctgtcgggataaggctgtccaccacaaaggatggtttctcaagcggttcataaaggagcgtttcggcgttgactgtctgtaacttctgcatggctttcctcctttcgggcggtgtctttgttttcgttgcacataggcgttgacctccttaaaaatagatttactcccacggaaaaaagtgagagtatgtaatgccgccaatcccacacaaataaaaaacagatttctttttcgggcggtgtcggtcacggttggagatatttcttcaatttccgcctttactttctcctttgcaatcgcaacagatttctgtattgccgaagcggtgcaatgctccatagcggcgatttggtaaaaattgaactcatactcgtagtagagcaggaaacgccgcctttgtatctctggaaggctcccaaccgccttatagagcgtttcattccgttcttcctcaaccatgcgttcatcaaggctcttaggcacacgcaacgcccgtctgtaaagggtttcgtcccatacctcgttaaactccctgtgccgctcgtcccattagaaaagattcctgttcctgcgctccatctgccgaaactccataaagaactgttccgacacttccaactcgtgggatttgccctgcccgtccttaaagctgataaaataccttgtgccgctttccgtggattcctcccgaagcgtgtatgccttaaccctgtatgccatcctgttgtcctcctgcaaaaaatgagtgaggggatttccatccctcacccagtagcccgcaggatggcaggctgttttagaagctataaaattttccgcagcttcttccgcagatggtctaacctcgcatagatggcaccagtcgtcaaatgcacaagcggggcaatctcctttgtggaatacccctgcattttcagcaggacgattttcaaggtacgcccgtccaccgtgactaatacttgatagagattttcgctctcaatctcttccagtaactccgcaaccgtacccacttccgcctgccgctccctgcctgccatgtcctcaagatattccgcaacgtcattcgtccatcggtaaaaccgcctgttggaattgaagtctgccctgtccgccatgcgtatctgctcaatggtcgcttcatcaacgccgcactcacgcagcagcttttcctccgcttctttccagatacgccatttcctgtcctcccgtccgtggttgtatgccattcttacttcctccaatcagaattgattgagagggcagagaaaagccccctcatcttcccaaaggaaaaaacaagggggctgaacgccttaaattttaattttctattatctttcttagttttattaggattctggctttgcgtttgtttacaacgctctgggttatgcccaacctcgccccgacttcacgctcggaaagtccgtcaaaaaagattgcctgtatcagctcctgttcactatccgacagcaaaggcagggcggctttcagcctgtccaccatgaccgcattgacaacggtttctgcaatgtccaccgcttcatcagtgataaagtccagaggattcccctcgctgtccgtaaatccgtcgagagatagcagtctattctttgtatctaatttttgcagataacgccaccgttccttgtcacggtagaagtctgtgtattgctccctcacgacttcaagcagacagccttgaatggggataaacagcttgtccatataggtctggtcggattccctgcaacggcagaactccgtgtaggataattccacatagccgccactttctctgatatatacctttcttggtgcatatttcaccataaatacctcccatctgaatttttgaaatgtaaaaaatccagatggagaggcggagaacgacaccgcatatcagaaacagccctacggcactttccaacaaaaatcgacaaaagaaaaaccgcaaaggctctgtgacctttacggttataggaaatagtaattctattgtatggagattgtacttctactttcaaggtgagaagtaccgttgcactggcagaaatttttttaactggtttcctgccgttctctgatatgctatgtattgataaattttgcttcgtatgagcagatagataactgcccgaaaaaaggacataaaaaaatccctccaaatttaaaaacaaattcagagggtaatttagggtataacaaaataacccacccgaatatcgttttttttatttggtgagtttgttctttcaaatacgaaacaaaaagagccgatgattcgtgaattgttccacaatttcatcggctctgcgtcttaagcgtctggctctttgatgacagttatcttcaagttgtcaactttaatcaatctttcttgtctgcattttggacaataaaggggataattctccaaaacagtgtccttcctaattttattacgggttttgctcccacaaacaggacacaatatccattcgcatttcatcataattagtctctaatcctttcaaatctcattttatatgacttttgcaagctgttaagctaacttgtggaacatatgccgaaccttatctatacggctattcgggcggcggggttggcaaataaatttaccaatagctggctggtatccttttaactctgtcaagcagactccctgcccatttgtgaaataagttaaatcgttcctgtattcttgaatacatctagcagggatttctcctttcagaatgacctcgtcattctttatctgagtacttacaatatctgcacaataccttggagcatcatgatacgcccgtgagagatattcctgcggtgcataaatttcaaagtggagatatggctctaatagttctgtccctgctttttttaaagcctgctccaatacgataggggaaagcagccgaaagtctgcgggggtacttacaggactataatacaatccatattcaaaacagattttacagtctgtcactttccatccatacagcccctgctcgcagccataaagaaccccctccataaccgcattttggaacgattgatttaaatatccaagtgaaactctgctttcatactgcactccgcttccaatagggagcggctctatggacaacccgacagaagcccagaaaggatttggcgggacttctatgtggatggtatattctgcttttctaagcggtctttccatatatataacagtaggctcttttatttctgcctccacatgatatttttcctcaaggatggcacaaatgacttccatctgcacattccccaaaaaagaaagtataatctcatgcgttgtagtatccacataatattttaaaagagggtcgccatctgaaatttctgtaagtgccccaagcaatatttcccgctgttcagatttctttactgcaatcgttgtttggagcatagggagaggattttcaataaattttctctgcggcaacagtatttcgttccccaaaatactgtttagctgcaaaacatcatttggtaaaattacaatatcaccagagcaggctgtatcggatgaatataattcaccgtttgtcggaacacacatctctgtgatttttattttctctttttcagatattctaataacatccctcaaatgcaatgttccgctatatatacgcacataaacaaaacgccgccttttctctgaatattcaatcttaaaaacctgcccgcatagttcagattgaccttcaggcgttgatgaataaaatttactggcaattacttctataagctgccgaatccccagattgtttttagcgcttccgtgataaacgggaaataacgttccgttttggaatctcctgttttcttcctgttccagttctgacattttaaacggtttccctgacatatatttctctaatagttcatcgtttcccataattaccgcatcccactgttccatatcgtcattgtccgttacatttatatggggatgctgcccaaccttttgcttcactataatttccgaagaaagctttgctttcatttcccgatataccattggcaaatcaatcccctcttggtcaattttattgatgaaaaaaattgtcggaatcttcattatctgtagtgcatgaaacagtatacgggtctgtgcctgtatgccatcctttgcagaaactaataatactgctccgtctaatacggataaagaacggtatacttccgccaaaaaatccatatggcctggcgtatctataatgttgacttttacatcctcccactgaaaagatgtcactgctgtctggatagtgattcccctttgacgctccaaattcattgtatctgtccttgttgtgccttcatctacgctccctagttctgcaattgcaccactggtatacaataaactttccgttaatgttgtctttcctgcgtcaacgtgagccagaatgcctaagttaattattttcatgtgattttcctcctatcaacacccaaaaaagggcataaaaatacccagtgataaatactcctatcactgggtaaataactccaatagccccaaaacacttatatgttttcgggcatataaaattacatgataaaagtattcttaaactgggtacaaaaaactaagccccatattaaaagtgaaacgggactgctactttttgttcccactatcaaattgacagtttatttaagaataccttgccgcatatttattaactccttgtataatactgaatctaattatattccttaaccctttatttgtcaagctgacaaactaaagcagaaaaagcggcaggatttccccctgccactaatcatctgtttatgcaaaaataatttccttttccacaatctccctcgcacaagcccttatgttattgaggcatcctgtccattctaaggcgttttctgcctttagctgttccgttatgccctgtgcctgtttcataccctctatgagcctttcaaagcgttcctgtgcctgtctgttgatgtcggcaaggtaggcgtttagcctgccgcttgtaagaagattggtgtatgtaactttacggtactgttttagataatctaaatgccgttgcccccagatgcctattgcctgttcttcttcggcgggtacagttaagcacggtatcaaataatccccttgcctttcgtatttgccgcccagttcctcaaataatgattttgccattgtctgttacctccacattcttttttattttgaatgtccgcaaaatccgtcctacatccgctggccgccacggacaatccagatggtgcagggcggcaagccgggtctggacgttggttcccgcgcccattttggccgtggagcctaaaagcacccgcacctggcctttccgtactttggcaaacaattcggctttctgcgtttcggttttcgcgtcgtggatataggcgatttcctccggcggtacgccctgggccatcagcttttgttttatatcatcataggcattgaatgaaccgtcgtttttcggggtggacaaatcgcagaatacaagctgggtgcccttgatttccgctgtatcacgccacacctgaagcacatttttgacacaggaattgattttgctctccgggtcatcgggcagggaggggtcggccagccgctgatccagggccagctttcttccgtccgacgtgattttcagcatattgtcctggcggggttccacctgtcgagtgcgtaccagatcggcccgttcgcccaaatcctccaccatcgcccgctgaaaatcgcttggcttggtgactaccgtgattttatctgcttccggcacaggcagcttcaacatttcagcggtttgaatgtccgccgcttcccgccacatggacataagttccgggaggttgaaaaacttagcaaaccgggtcttggaacggaagccggtgccctccggggccatctccagcgcggtgatggtttcgccaaagttggccgcccagctatcaaagtgttccaggccgctttctttcagcatgtcatattgcaggtagcgcatcatggtatagagttcgaccattgaattactgaccggggttcccgttgcaaagacgacaccgcgcccgccggtgatctcgtccagataccggcacttggcaaacatatcggaggacttctgcgcttcggactggccgataccggccacgttccgcattttcgttgccaggaacaaatttttgaagccgtgggcttcgtccacatacagcttatctacgccgagttcctcaaaggtgattacatcgtccttgcggctctggtcgtttaacttggccatacgcgcttccaggctctttcgggatttctccagctgcttaatggtgtagcgttcgccgtcctgtgccttggcctcctgaataccgtcgattacctggtcgatctgttcctgaagaatggatttctgacgctccggggaaagagggattttctcaaactggctgtgcccaatcaccacagcgtcatagtcgctggtagcaatccggctgcaaaatttcttccggttggccggttcaaagtcttttttggtggccaccaggacgttggccccagggtagagccgcaggaagtccgcgccccattgttcggtcaggtggttcggcaccactacaaggctttttttcgtcagccccagacgcttggattctatggccgcagctacaatctcaaaggttttgccagcaccgacacagtgggccagcaggctgttcccgccgtagagcatacgggccacggcattacgctgatggggccgcagggagatttccgggttcataccggaaaagcggatatggtcgccattgtaggaacggggccggattgcgttgtagagttcgttatacttcctgcacagatcggcccgacgctccgggtctttccatatccagcttttgaacgcctcccgtatctgttcctgcttttgctgggccagcatggtttccttgacattcagcacccgtttatcagaaccgtccgggtcgtggattgtatcgtaaatccgggtatcccgcagatttaagctgtcctcaataatcgcgtaggcgttgcgccgcttggtgccataggtcacataggccagggagttattcacgctgtcccgtgatttcccgctgacattccattctccggtggccggggaataccgggcctgtacctgctcatgcaggtagccgggagttttcagcagttcatggacaaactgtgtgtaatacctggtatctatccaggtaacgccgatccgcacatcaatttcagcggcggacaggtcttttggctgggcctgttccagcgcagccacgttatcagcaaaggccgggtcacgctccgcagccacccgcgcagcggccagctttttgcggacgttgcctgacaggtattcatcagccgtttcccaaccggcatagggattggaaccggcttcggggtttttgaaaataacaccctttaagtcctcgatgataggttccacatcgcccggcctgcccagcagtgtagacataaagcccaggtcaacacaggctcgttccccgatggaaacggccagggcttcactggcggtatctacatggtcgatggaaacctgctgattgatggtacgcttggtgaacatatccgccttgcgctctaaattcccgtcctcgtccagaatttctaaggagcaaagcaggcagtaggcggaatcctgctcaaacgcccgtttgttgccggtgctgttcagcaatccgaattttgcggtaaaagtgtcataggcggtattcagcttggcctgggcctgcttaatctcctcgtcggtgccatcgtaaagctgcaaatcaatcaggttacgggtaatttcccgcagcccaatcattccacggatacgctgggcggtggcagcgggcaaatcaacagccgttttatcgccgttttcaagaaagtacagcttcccgccgatttccgtataactgaaattccgcgccatcgggtcaggggcttccaggctttccaacagttcatcaaccgtaacttcggttttttcctgaagcaaacgctgatccggctggcttaaattttctatcgcagccgcaagctgttcttccagcgcggcaccaggaaccggctcacaggtggtttctttctcattgccgtacatgcttttatcccaggccattgtacccagcaccatttccgggtgctgttcaaaatagcggttgatggggataccgtccgcagtctggcccagatgtacccactccggcagctgttccggcgggctttcacgcttttggaggaacagaatatcgctggtgacttccgtaccggcatttttagcaaaggcattgttaggcaggcgcaccgcgcccagcaagtcggccttttgcgccagatattcccgcaccgtgctgtcctgtttatccagagttcccttggaggatatgaacgccacaatgccgcccggccgcactttatccagtgttttcgcaaaaaagtaatcgtgtatcaacaggtttttgctgtcatagcggggatcgggcagcttataatttccaaaaggcacgttgcccaccgccagatcaatggagttatccggcaggttggtatgttcaaaaccgtctaccagaatcttagcctgggggtaaagctggcctgccagccgcccggtaatgctgtccagttccacccccagcagagtagcgccctgcatagtttccggcagcagcccgaagaagttgcctacccccatcgccggttctaaaacagtttccggctgaatccccatacggcccaccgcttcatagatactctgaatgaccgtggggctggtgtaatgggcgtttagggtagagccacgggccgacgcatattcctccggggtcagcagttctttcagttcggcatattccgcagcccatttctcattggcttcgtcaaatgcctggggcagtccgccccagcccacataccgggcaaggacttcctgttcctccggggcagccaaacggccctgggattccaggtcttttaagagccgaattgccgccacattattctgaaacttggttttctggccgcctgcccccaggtcaggatcggtgatatggaaattttctgcggcaggtgcctgttccggctgcatttctgcttgatcgggaatggcctctttgatttgccgccattcttcatcggttacggtaatatctatctcatgggtggcggggccgttgccgatggtcagggaatctccctttcgggtaatggattggccggttaggtcgggaacgtgcgggaacagggcggcatttcgttcatcatgccgcagggcttcttcaaactgcgggcggctgatggtttcatggctccaggaataggggccggtatctatccgtacatcgagttctcccacatagccgatagtgccagcaatattccggccagggagaggaagatgaaccgaatcgcccacctgataggagggcggcccctgtaacgtcaccggctcctgtatgaccggctcatggaaaaatccgttctgctccgcttgataaagggaacgcagaaccggcgcgaggtctgcccaggaataagtgcgtttggtatcgtatttatcaaaaatgttgatttccaggctggtggtgctggcaaaatagtccgctgtttccccggtcacaagttccatcgtttcggcggttccggcataggtatcggaaagccgctgggctatgcgggtgttgccatcgcccgcccggaagcactctgcaagcagttccttatcccgttgttccaacagtccgccatcgccggtcaggacttcccggagatccgcgtcaatgctgtttacagccggtgccagaaattccgtaatggctccattccgcgaatcctggcgcagcagccgttcaaagttttcaatccgttccgagcgaaaaataggataggccagggccggatcaagcaattccacatagtccggttttaagccggtgacttgaaacagagtatcttccagataaacggaatcgcccacctgataagccggggccagcgggtcacgagcaggaacggcactgacatttgcggacggtttaaggctatcagagccgcccgcgccggcactttcaacaaccggaaccgcctggggtggtaactttccctgggcaccctccttttgggcttctaacggtccgcccccggctgcttccggctgggatacagtcagagccgcccccgccttttccagcacttccttgtggagccgggtatgaaattccgggaagtcatagtaaagccgcagcagttccggttcattaaccgccagcaccgcccgttttacagcagcgtcaccctctatgcgaatattttccggatcgctgtttttcagtgcattttggtaggcttcatcattcaggacacgggagagcaccaccggctgatattctgcgtaaatctctttgagggtacggggcggcaccggctccgcttcctggatatccgggccggaagccgattcgcggcctgtcatagcggcaaggtcaagagaaagctggttatcctctttgccgctttcagcaaacaggttccggcgggccgcttccagagggttcccctggggctgctctttctttttttgcctggaacgggaagaagcgggggccgcagcctccgcttctttttgggcaattttttcaatttgtacctccggcagatcaaacaatgtcatttgccggtaggctggctgggtggagaatggttcctccagttccgcagaagaagaaacggcaggttttacacccgccgtttcttcctgcttctttagctgtaaatcaggtcgttcagcacgacttcctccgccgccagcctgatgttgttcattttctgcacccaatccatttgattggccgctttcagggcttcgttcacgccctggctccttgccatctccgccatcagcgcgtccacctgtgcctgcgccgccttgtcgatctccgtcaggtgcttccatagtttgccgttgagcaccatcgtactgtacagccctttcctgtgttccatcagatatttctctctggctctcccgaaccggcccagggtctgcgctttcccgtccgtttcgtccattttcaggttcggcaccagatagccgttctgtttgctgtatgtcaatgccatctttatcgcccctttcgcgctttaatgtgttaaagttcctgccatcattataagccaccgcttcctgttttgcaagaggttttttgaccttttcccgttctatgttccgaatcgtgtcgccaatctccagcaggattgtgcggttcacctgggccgtggccgtacccaggcaggctaaggtggcgatggtgttgaaattcgtaatgccgcgtaaatcttcctcgtccagatagcgggaagcgtccaggccgcaccgggtcaggacagcatattgaacgctggcccgcagggtatcgcggaatgtgacctcgatgttgagatcgtccagttcttctaaaaagctgtcctctttctcatatatcaaatccgtcaggtaatcgccataggtatcctccacggacttggccgccgcgtccatgagcagatcacccaggtcatttccaccctcggcaccaaaaacttcccgcagccgttccataaccggcatacgggaatcatcgtccatgctccacagccacgggtctttccctccgcggacagggtgggtgtccgccacatcatgcacatagtcaagatagggcttgccgccgtatcctttacggaccagggcaatggccgtactgccgccgttgacccagcggcgcattttgttgttccaagtaggcatatccgcacaggccgttgcgtccggcttctgcgcataaatcaaaagttgatcgtcaaaatcataggctttatagaagcggcccgccgttgtcaggaatcgccgccactgttccggcgactgtgtgacctgcctgctggtcgtttccgccagttccgaaatggtttgccatttctcagccataggaacctcctttcaaacaacaacactcggaacctgctgtcagcaaattccgagtgttgtttactcattttcttatgaatcttcctgtgttacattgtcggccatataccggaggaattcttccggtgtgggtatgctgcctttgcacggcacccgcttctggtaggcttttgttatctcattttggttcagtgggtcggtataggcggctgtaatgcaatgctgtatttcctgccgtacttcctttggggtgacgccgtattcttttgctactttccggtaaattctcctcatgctcataaaatttcctcctgggtaaaaactatattcgcttattcaatgacattataagcgattgtatcgcttaattcaacaaaattggcgatacaatcgctcggttttgccttttgcgtgaattaaaattaccaacaggaggaatgatgatggacgaacaatttatacgcaaccggcttaccaagctgcggcagcaaaagcaggtttctgaacgaaaaatgagcctggatttaggtcacagtaccagctatatccgcagtatcacgtccggcagggcgctcccatctatgagcgaatttctttatatctgtgaatacctgggtacaacaccgatggaatttttcaacgaggaacacgaaacttccttgattgagcaggaagccaccggctacattcacacgatgtcggagcaggatattcgggccatgattgagtttattaagcaactgaaaaatgcggagaagtagcaggcggtatctggaaagagataccgcctgttcttactttctgcgttcctggttcctgcggttcatatcctccagaacctttttctgtgcttcggagagcgcccgcggcggtgcgattttcacccacttcttcggtatctcaaaggtcaggccgccatgccggttgtcctccgtccggctggcctgggccgggtgggattgacacagttccagcaatatccgttgcaaggcggcattgtgggtatagacgctggccgtggcctccgcttcattgaataaaacaatcgtttcctgttccactttcgtcaacgtcatgggcgttacctctctttctccggggcgggccgatgggggccgggcagggatttattctcctgtgccattcgcagctttgcccgcagagagggcggcttcccctcattctggtcatttagctgctcctgggcgcggcccatcaaatcacgctttgccgattgataatcgttatagtagtggccccaggtgaaatccgtggggccgccgccgtccacgcgccgccaggtgacaaaaggctgtacggcctttggattctcccccaaaacaaactccacgccgccagcgtccacgctttccagaatggtatagccctgattgacacgggcaggcttttccggttccggggcctttgcctgttcctgctcacgttcccgcgccgggggctgctccacaaaggcgatgatctccccgccatcgtagcggatcggcgcgaacacccgcccagtttgaagaaacattccgtccataccggcaccggccttatagttgccctggctgtcacgttcactttccagcagtacaaggccattgtccaacacaaagcccggttcctgccgctgattcacaccgggcaggcccattgtaactgtgaaatccgtgatagccgcaaactgctcacgggcaccgacctccgcaaaagaggagggctgcaattcgtcgccatcgtaaacgggtacatacagcttgggcttatccgtcgcgccggtcacagtatgatcggcggattcatatacgccgggggcttcctccatgaaatagagaagcgttccattttccaaaatgtactccacgccgggaacattttcgtagcgcggccccaggtattgttcaaaggtgtcaaagggcaccacatcccattttttctgttcctcattcatttcttttcacctgctttcctcggctcaaattccagcttgtagttcacatatttcccggtatcgtccagcaccaccaccgcgtcgtaggtggtccctttcttttcactgaacaggccactcattttgacgcgcccttttttcagcagggcggcggctatggattttgtcagttctttatgcttgtttgtaaaaaagcggtcattcttccacatggtaaagccgcaggaacgatcagagcattggaaactcagcttgctttccaccacatcttttccgcagcgggggcatttcccaatgctttcccgcaggtcgaacagggccgtatccgcctggacagcccgatagccctccaccagatcggcaaccatgcgttcaatcctggtcaggaagtcagcggcggcctgctggccgtgctccacatcttttagggcggcttcccactgtgctgtcagcttggccgacttgatactgtccggcagcacgacaatcaggttatgcccctttttcgtaggaagaagctggcggcccttgcgttccagaaaaccgccgcgcaccagcttttccagcactccggcgcgggtggccggggttcccaggccggtacgctccacaccctcaatctctgcaaattcctccgcgctggcatgttccatcgcggacagcagcagatcttccgtgaaatgcttgggtgggcttgtggccccctcacgcaccgcagctttacacccggaaaacgtctggccctcggcaagcggcggcagggcgcgggcctccggttcttctttctccgttttctgcttcagcgtggaaagaaacatctgctctatggctttccagccgggaaccgtcaccacacggcccctggccgaaaaggacacgccgccacattccagtgccgccgccgtatcctcataaacctgtttttctcctacagcacacagcagccgcactataaccagggtcaggacattccgttccccggcgggcagggcggccagggtatcacttcgtacctgcatggtgggcaggagggcatgatggtcactgaccttggaaccatctactacgcgggccacatcaggcggccccacctctacagaaaagggcaggctttgaacagccacttccaccagccccggcacggtggccgccgtatcttcggtcagataattggaatctgtacggggataggtcaacaacttcttttcgtacaacgcctgggcatagtctaaaacctgctgggccgtgtagcccatcagccggttcccgtcacgctggagggaagtcaggtcgtacagcttgggcggctgggtggatttctgttttttctccacgctgcggacagcagccgtttgccctgtgcaggccgcttgcagcttatccgccgctttgcgctcctgaagccggtcactggctgcgggaaagccgcagtccagttccactacatagaatttttcttttttgaatccctcaatggcattttcccgttccaccacaagggccagggtcggggtcatcacacgccccacgctcaaagtgcggtgatacagggtggaaaacaaccgtgtgccggtgatccccacaagccagtcagccttggcgcggcacagggccgcttcaaacagccggtcatagtctgcaccggggcgcagggccaaaaagcccgcccggattgcttcctcctccatcgacgaaatccacagccgttccatcggtttcttacacccggcctgttgatacaccagacggaaaatgagttccccctcacggcctgcgtcggtggcgcataccaaaccgtccacatcggcccggttcatcaggtcggccagcacctgaaactgatcctttttcccagggtccacggtaaactgccactgtgtcggcacgatgggcagatcttcatatgtccagttggaatacttggggtcgtatgcgtcggcgggggccagccccaccaaatgcccgacacaccagcttaccagccagccgccgccctccaaatatccctgttttttctgattggcacccagcacagccgccaaactctgcgccacactgggcttttccgcaatgactaatttcatgcgtgtttcctcctttcggccagcaattctttgtagcagacaccaatacagcgccgccccatgccataggcacagccatagcaggggtggtcggacgggagagccggtggctccggctcccgccgcccatcaggtttctgcttcatcatgcgttccagccccggcctgttactgaacagggccatcgtccatttcctccggttcgtcctgttcctcctcataaagccggcgctgttcggcttcctcctcggcggttaattcggtggattccaaatcttcctcccggacggtttcttcctgcggcccctcaaactcaaattcatcaagatcggcagcgtcgtccagttcatgctttggtttataaatcttgaagtagtagcccaggccgcccacggccagcaccgccacaccaatcagaaccatcataagggggctggttccctgggtctgcggctgttccggttcctttggttcctctgtcacaggttcctccggctggggtgtgaccgtaggttgcggttccggctccaccggctgtgcggtggtggtatccccgtctttttccgccagggccatcaaatcggattctgtgacagcattgagaaaatacacgttatccgcgtcgcgctgtttatcaatcaccagataaaatacgttttcgtccggggtcacaatggtataaaactctttttcgtcctcactggtggcattatccagcacggttccggtgcccttgggggtaaacgggttcggggtggcctgttccggctctgcggtttcttctgccgcctgttcggtctgcggttcgctactctgtgcataggccgggatagaaaatacactgacgcacagcaccacggccagcagtgcggtaagggagcgcagcttattcttcatcttccaaatcctccttttctgcggataaagcaacaggcgaaccgccagccttgccgctgcggatcgcctgaatgagcgtcgccagttcttcgggggaaacgtccagcccacgaaccatgccgacgatttccgtattttccagttcggttttctgctgctccaactcacgcagccgcgcttgctgggctgtgattttagccttgactttttcaatctcggcttcaactttctgaatttttccgttcatgtaaaactcctttccgggcggttaaagccgcccaaacgcatagaaatgttcctgccagtaggaggaattgatgttggcgtattggattggggaaccacagtgaatcatcattccgtcgcccacatagtagagtaggaaagcaccgcctttccttatttctaaggtaggtttgtgcagtcctctccccgaaccgtgcttgcatttctcaatgcacacggctctccatctttgctccgttacaggttatttcttttcgccatgatgtatagccatgtgacacttgtggcataccacgattgttttccgtcttttggctatcattatcttttcccattctgatttccctttaaggtttttaaccttgtttacatgatgaatttcgtatctgtcattttccgtacacccacatacttcacatatcttcgcctttaatcggctttctaatgttgttacgtcatgggaataatttttagctgtttgtggaacaatatcagtaaacttctttcctttgcagtcagcataattcgcaaaatacattttctttattcctgttttagtttcataaggaatagcccatttgcctgtaccgtctttatacatagctctaattttagaaactttagaacggtgctttcctgcaagtgttttcaaacaactatattccataagataattgaaatagattagcttgttaaaattgcttgccaatccataataattacagatacctcttaattctgcattataaatagtcactatttccaaatctgtcctattaagcagttgtggtcggtatataggttctaatttcccattgtctgacctctgctttacaattccatttgaaaataaaaatttctctatcttgtctttgaatggaatactcaattccaccttgttattcatagaacgggttttgaattttccttttggtttaatctgctggtcacggcgtactctgacatcatatccaagaaaacgagcaggagtattactgtgtgtaatcagagttttttcttgactaagttccatttttaatgtggtacttataaattctgtaagttcttgcttaatcttctcacaatcctgtcgattgccattcacagctattaggaaatcatcagcgtaacgcacatattttattttcttgtcgtcacattgtttcgctggtagtttgagcatttgagccgttgcagttttatattcttcaatcagcttttctctttctataccgttgctatttttaattttgttgtgtaatctttggcgtagtcctaccagttttgtatattctggtgtataacgtgcctttgttgccacatcaaactctttctttattttcattacgtgacggtctaattcattaaggtagatattcgcaagaataggcgaaatgataccaccttgagggcaaccgctatatgtttcgtggtatttccaatcttccatataacctgcctttaagaatgaacgaatgagtttcagaaaacgtgcgtctttaattttctgattgataatttccacaagtaccgcatgattgatgttatcaaaacacccttttatgtcgccctctataaaccagcgtgctcctgtaaattctttttttatttgagcaagagcagtatgacaacttcttgctggtcggaaaccgtgagagtagtctgaaaaaataggctcatagattgcttctaatatcatgcgtattgcttcctgtatcagcttatcagtaaagacaggcagtcctaagggacgcattttgccatttgattttttgatgtatgtacgtcttactggttttggttgatacatttcattttttaaggcatcaatgatattttcaatatatatttcgctaaaaccgtccgctgtgtcgtctgttacaccctttgttcctgctcctttgttggagtagaggtgttggtatgcaacatagtatatatctggacggagtaaataccgatagagccttgtaaatacttcatcatggttcttttttgaattttcctgtaatttggttaaaatctccattgttggtttcatttgaggttttcctccctaatcaatttctaattttaattcgctaagactgctttccttcgccatgtgaacggttttcccgtatccgattttacggctttccctgtcttttcagggttctcagactactatgaaagctccgttaccttgccagattttcagcgtcatctcacttagcatagccttgtgatttatcactgcaagagcattacgcatagccattgttggcattctggtttaggtaatctccagttgacgaaagtagtaggctagtgtgaattgtcggatatgctttcgttccgttactactggttctccagcgtaccgtatgagttaattgataacccactgaaaggcatttattttcagcgttactcataccacaggtttcagacaagtttcctgtgtccacacgtaacagaggtttggaactcacattcaacaaatctagttttatcctcatattcacttaaccttgcagttcagtcgtgctctattgtctttgaacaactttctgctttcctgccgtgctattttcccgtacagttttcgcctttcggttaggcaggtggtttcccgtgttatcttacggagtagtgccttttttctgtccccctttctttaatctacttctaactttcgtccctctggacgcacaataccgacgtgcgacaccggcccgtcgctgttataggttttcgtgaagaaaatcaggtcgccgggctttgcttccgaacgtgatacaatcgcgcactggttgtaaatgccggtggccgtagtccggggcaggttgtgaacaccggaatgggtgtaaacatagcagacaaaaccgctgcaatcaaaagaggttgacggggaggagccgccccagacatacggataccccaggtatttttccgcttcggttatcagcgcggcaaaggacgggtcggacaggacttcccccggcacctgataatgctcaccctcggagggattggcataaatgtcatctccgaacaggtagggcttattgcctttgagttggagcagggccgcatatcgctgtttttcgtcctctgtcagccgttctgaaaggatcgtgcccagggaacggttgcgcagggtcacatgaagaatgtaatattcgtaggcttcttcctcctcatgttcgtcgccatcttcatctgtccaggtcacggtgcggtagcgtatctgcacctcctcacgggtagtcaggatatattgctggtcgaacagggcctgtaactccgtctgaacctgggccggggtgaacgcattgaatttagcagtcagatacgaaatcaattcattggggtaatggccgatggtgtctacgtcatactgatactcgtcatagccgggaaattcactttcaatgttcgccatacggcgctccaactgcttctccaggtcggtatagccattgttcacctgcaagatgtcaggatcttcggaagtataggaagtgcctaacacggcccccatcgctccctccattgtcacggaacaggaggacagggaagaaaacaccatgataagtagcagcgcgataccgcccacaagcagcagcacccctttgttgcttttaatgaccgtgacagcagcatggccgatgttccccacggcttccttggcttttttcaccgcagccgcgccgcgtctgccgtttttatgggcttcccggtaggctttggcatattcccgctttacccgccgcttttggtacatcgtggacagggagtgcttttgcagttccgggttatcccgcacagccgcccggtaattggcgtttacggtggctttggcactcttgacctccagcttatccaccttgcggtagggggtgtctttcgcataacggtagccgcttttgaccgcaccagccgctatattttctgctgcaaactctgttttgtgggcggcttcggttcccacattttcatgctccacctgccggattttgttgtgtaccgccagatcagcggtgcggccagctttgagcgcgcctttggccgccggatttttcttcccccgtggccgtacctcctcctcaaaatgcagagtagggcggactttgccagtcgcagaatcaaattcccgctttatccgtgggcggtactgcttgggtacttctgccttggctttctctaatttctggcccaggacttccgcctttttctctgcatgggcggcccgttcctctgcggaaaagcgcagccgcttacttctggccgcgtcgtccgcgtcatagatattacgctttcgtttcataggatttattgaccatactaaggcttactcctttcacagattttggtatcacaaactcacttcatgctttttggacggggtcggcggcttctccttgctttcctgttgcttcgccgctttcaggccctcacggacagagggcttttcttctttccccctggccgcagccttttccagacggtcaatactctgcaacgcacgggtcacgcctttttccatgccctccagcatagcctttgacttctttaacggttttgcaatcgcggccagaacgcctttatcctcattccgctgtgtcagttcggcggcttccttgccaatcagagcacgccctaaatttttgccgtgctcattgagcgcgtgaagttcactccccacagcgttgatacgatctatgcttttctgcgtatcggagatagaggcgttcagattatccctcatatcgttcagggcggcctttatccccataaagtcggctgctttgttcagggcagaaatgccgtgctgcttcaccgccgccagggtttgcttcaccatatcagacagacttgttctgatatggcctaactggtcttttgcctgctctaccttttgctgtgccgatgatacgctttttgtcaccgtggctttgattccgttatcctgtatgctctcaagctgctcccggactgctttcagttcggacaaaacagccgtgtactgtttttccatctggttcagttgcgtaaccagggaagaaaactcagaggcttcctgttgctggccgttttgagataacagcttgaaaaattctttaagatgttcctgttctccgatgggaacctgtaaagtttcgttcacaaataatctcctttcctgccctgtgtatcagcggccccttatgccgccagatcggagggcttggtagtcataacgcggtatagctgtgtatcacgcgggaatttatccacaaagggaatgatcttatccccgaagaatagcaggccctcaccctcaccgctgttggttacatgggtcagttcctggggtgaaatccctaaccgctgggctaaaatgccccggtcactggcaccctggttgagcatgagaatgaaatcgctgttttccaggatattttcaatttccgggctggctaaaaggtctttgacattctgggtcagcgatgtgggaatgccgttccatttcctgaatcgcttataaatctcggctgtataggccgcagtctgcggctctttcaggagcatgtgaaattcgtccaggaaaatacgggtggtgacaccggcgtaacggttaattgtggtgcgctgccagatgtgcttctgcacatttgccatgaccagcttttttaagccctggcccatcttgctggtgttgtagcagacaagccggttatttaagtccacgttggttctatggttcagatacgacagactgccagtgacgtaaatttccatcgccgtagccagatcgtccgccgtgtggttatcctgtgcccgcaggcattgatacaggtcgcctaaaatcggcatattctccggggtggggcgtttcagataatcccgatacaccagactgatacagcggtcaatcaacgatttttcaatcggcataagcgggttcccgtaggaagccatcatcaactcacattgagaaagcaggaaatcggcctgcatgagcataggcgattcccctacatcggtggataagtctaaatccatcggattcagatagctttggctgtccggtgccaggtagagtacctggccctgaagctgctccaccagagcggtgtattcgttttccacgtccagaatcagaatgtggtcgggcgtggcaaaaaaggagtttgcgatttccttttttgcgaaaaaggacttgccactacccggagtgccaagcactatcccgttggggcatttcagcgtttttcggtcagccagaatcaggtgtttcgtctgcgcgttcacaccatagtacaatccgcctggctggaatacctcacaggaacggaacggcaggaagattgccgttccgcttgtggtaagcccccgttgaatttccacctgattgacacccagagggagcgcggacaaatagccctgttcctgctgatagtccagccggatcaggtcacagttgttggcgttggcgataccattcaccgaatagatgatgttttccagcttctgtttcgtgggggcggtatgcaccaaaaggattgtgaccatgaacatcttttcatcatggttctgcaaatcctccagcagcttttccgcttccttgccgaacgtcaccagatcgggcggcagaatatccatatcgaaaccggagcgcaccgcccgcttttgttcgtcaatctttgccttgtccaaatcgctcagtttccgcttgaccgctttcagcgcggccccctggtcgagtgctttggcgtgaatgctgacaatctggctgctttcgatattcagcagcgcattgagcagggtatcgtaaatcttggtggcccggatctgcaaaaaggaaaccgcgccgactgacgggccgacgcggaagtaccgcccctccttaaactgaaaggagctgggcgcgatatagtctttgctggacaggccggtgcccgtcagggaatcccaattaaaacggaatttttgcggttcatctaaatgcaggcactggtggagcagcaaaagccgttcataaccgtccatgccgtgagcctcggttccaatccctttgaaccggacaagtacgtccgcttcaatctgttccagccgggaagccgcctgacgaacatcgtctgcttccacagtaaaggtcaggcacaaacgacgttctgttttacacaggcccgccttggagagcagcatatcgctgtattccttgcgaatcgtgtcaaatccgtcgccggtggacggtatccgcaggattttccggtactccgccatatcgggatagtagcagactacggacaattcaaaggccacagacgggccgaagtagttgaccagcctgcaatacagttcaaaaatcacagccttgtcatcgtcggaagcctcggcatagctgcaatcttcaaaggccacgcttttactgtaaaggcggttccccaggctgcacaccccgttttgatacatttcctcatagggaatggtctgctgggcactggcggcgattttaccgtcgcgctttgcccgtttgatggcctttgccagttgttttttctgcgccggtgtcaggggcgtgtcgggccggatcaccagttcgtcgttccacccgaccatcttttttggctccctcctgggaagtttcagtatttgaagcaagccacttcacctcctcgtcaaaataggcttgccgttccaatgcggcaaatcggttctgtgtccggtaggggcgctcatggcgcgtcaggaaccggacacggatatagtttttcagttgcttttccggcggctggccgttcttctcataaagtgcaaagaagaaaaacggtagcgccgtgacaatcagcagaatcagggcaatatcgttgcccaggctgtcgcgggtcagaaagtaggtgggcgcagccaccagcgcggccagcacaaaaaagataagctggcggcgggtcaggccgaacacaaccttgcttttgacctcggttaagtcctttgtgatatttacatgggccaatccattcacctcctgttattcgttcatagtggcggcccgctttaatgggcgttcagaatactctttgccacgccgcccgacttgaacaggctgaaacacagcagcgcggtgtaggcgacacacgaccagattgccccgtgcaggtcgccgccggatagtgacagcgtgttgaccaggactgcgtaaattccggtaatcaccatgattaagaagccttgcagccccagggccgcaagcccccggacatagttggtgccgatattgccccattcatggttggcaaaagtggcaaagggcagcggccccacgctggcgtaaatataaatttcaatcattcttccgaacaagatgatggtgatacaggcccccatgaccgtcatggcgaagctgactacccacgtttccaacatcagggcaaatagttctcccagcccttttgcttctaattctgtggtgatggacgctaaggccgatgatatgtcaatgctggcgttcgcgtcgatcactccggcgctttgctgcaccatcgtctgtgccacctcgaagatggcaacgataaagtcaaaggtatggctgacgacatacgccgcgattcccgccttgataatccacttaaagaagatgaatgtatcgaaatcgtgcatgttgttcttctccacaatcatgtgaatcaactcataggacaggatcgcggcaataacaaggcccgcgatgggaacaatcacagactgtgacagactgttaatcatggagaagacgccggagttccattgctccggcgtcttgcccacttcccccgcgatggtggcgaccttggtatttacatcggcaaacatatttgacaggtttcccgtgattgcttcaatcaggaaacttttgatccattcattgattgcgtcgatgataaaatccataggccgttacccgcgtcttagctgaataagccggacagcaggggaacgactctaaggcccaggagaatgacacctccgccagccataagctgcttgacaccctggcttttgctggccgggttatctccgccgtagccctccatcaagttgataattccccacacgccgacaccggcaccgatagcaacaacaaccgtagaaagagaagataccgcactgttaaagaaatccataaatttacctccttgaatttgaaaaataattgttgatagggtgaaaaacaaaaaaataagccccaccgtttgacagggaattgcaactcaaacggcggggctttaagccgcttcttcagaatcggcttctccgagatcgtagacctcatattgatcttccggctttactttcagccggtgggccaggtacgcttttacatcaagcgcatacttgggattcgcgtctgcggtgtacttatacatggggtggcgggtcaaatcatatttacgggaatagaacggcctgaccccctgaacctgtaaaatgcagcggcttgacggcatgaccgccaattcgtccacgcttttcagttctttgccacaatgtcaagtgatgaattcaaaaaagacaagcactatccaaagaaaaccttcttttatggtatctgcctattttgttttcgatagttttagctgtgatacatttaatttagagtgcaaaaaagcaggagaccttttcggatctcctgctcaataaagctataaagatttaattgtcgttggtcttccagttacacaaactggaaactgttagctaatctgtgccttgatttttatccctattcgtcctaattgatcttgaactacttgcaaaaatttctggcagttatctgttatatcatacttgaaatggatttctatcatagccatcttaaaatcagcattggggtatatttcatcgtactgttcgctttcgataaaagccacatacgcattgattttatcttgtaaaatcttcaagtgttcaaactcattgtcccaattcaaatggtcggtaataaggagtaccaaacaagcattttctttatcgtttgcgattgcatcaatctgacttgcgttatcaacagccataatatttctccttctcagttctttataaccataactctttctcccaatacatctgtgacattttctgtaacacaacttctaatttttgttttttacttaactttagtgtagctctccatactaaaagtttctaaatcaaacactaccgcaacaacattgtcctcattttcttcaataagccataagcgagtccataaggtttggtcgttcatattggtagcagttttatcctcaccatcggtaatgattttttcgggatctaattttgttacaaaaatgttttcgggtttaagacctggcaggctgctttgaagttcctcctctgttagtcctgctatttccattgcttcagcaccgttataatactcaacatctccgtaccagtagttatcgttaacattctcgatggattttaaccacataaacttatcgtcaacgaatttataaccagcaccagagccggtatctatttcccatgttccttgtatcagtgcattatcatcgttattatctttgctgtcagtagtaccggcgcaagcggtaagccccaatagtgtaaaacagatcatcagaatagctgctgcaattctgaaaaacccacttttgcggtatttaatcatatttatatcatagttcataggtaacctccaagttatatcctctttattttcgtaagcctttctccattgaaaaatgaagaaaatcttttattcccgttcccgtctactccgttttttctttcggggatctggcagcggagaaaaggtctgaatatagtcctgccgaatctctgtcacatcctgagaaagaaaagcagcgacacgatcttgttcggaagtttgctctgggaaaaaggacgcaaatttctgtgccagctgttcttctttttcatccagtttaagagtgccttcgtatccaatcaattctttcagcacaacagtaaactccttgtaccggtcccctcgaatatccagattgactttcgctttggccgtcatgccgttaaggtaaagtaccttcaaggacgcatcgtttcctgaccgattcattgtgacccacaaagccagcttttttgagagcagcttcccgccaatcagcatccagttctggcttcggtaaatttccagatactttttcatgccctcatcttcaaattctattggttcaaagtgttccccatccaacagctgctccaactgttttttactgagaatctgattcagtaccggtatgttccggtaaggcgcgcagatatagcgcctcattttctgaaacagtgccacaaccagaactgctgtaccaagtaaaaacaggaaaagctctccgtccatttcgatttttccgattgccgttacccagattccacgcagaaccagcacgacgccaaagccccacagtccgaaaatcagcagctttttcagcggatgaaaatgaatccactcaatgatctgtacctgttgtttgccactcataggtttgtcacgcaaaagtagatgggtgatccattttcttagaatcagtggaatccatgcagtcgcacacatgaagattgcaacactggcataaatgccaatcccaagccagccattatccagaaaagcttccagaagcagaaggaggataatcggaaaaatcatagtgaaaaacaagggtaaaaatgactccttgcgtatcctcttgagatttaagtcattaagcgcagagttgatacatataccaagaatcatggctgctgtcataccacctgccacccattttttacgctctccgtatcgcatgatatgtacagtttcgtgcatataaggaagttttcctgtaatacctacataaaaatagaatcccaaataagtcagagccaaaagtgcccctaccagcttcaaaattgtttttcctgaaagttttcgtttctccatcttcgtcgttttcctataaaatcactgttcctgtgtcaatttatccttctgtatcccaaacaaagctatctaccatgtctctggcggcctgttcagtggtttctgatccgctgaaatttgtaagctggatcaggcagaacccgtaatcctttacaatatagtattgcgtagtgacaatatcgccctcgtcgatagtaaagatatacagcaggtctccctgctcggtataggttccatccccgttcagttgtgcttcaataccatccagctgcatcaaaatctgttggacgatcgcatcccggaactgctcatgctcatccagactatatttgttctttcctacatggacggatatgttgtccggcttttcatcattttcgtgaccttcctctatgtagaaaatctgcgaatcagtagaatgcttctcagatttctcccatccctccgggacggtataacttccgggaatcgcatgatcttcagatgatatttcggtttcggaagaagaaggtttctgctgatccgccacagattcatcagagggagattgtggcgatgaagccccatttttgccgcatccagcaaggagcaacaccatagttaataacacaattaagatttttttcatgctctgattcctctcactttataatactggttatccgagattggaaacaatctggcagaacatctcaacattttctttctgcccctgaatatcagatccaatcgcattgttcatcaaagaaattttcattttttcttttcccaaatgcagcattacgacttttcttccgggcagcagcccacccttgacttctgcctttgttatgctgcttagaggcagagaaagccggttttcaatttttgagacattgacggaatttacaatgaccatattcaggtgttgctcggtaactcccagatagcagtaagcattgctcagtgcgcccaatgcagcggcagcgccccccgtcagtgtagaaagtcctccaatcagtgcataggtatcagccccggccatgatgaccgcccataacttgcactgataggcttcgttttcgttcaaaatggcttccagcatttcatttttatctttttcattcattgtaagcataattgttcctcctaattattgttttaagttgagaacgccggatgcaatcctttgatatatgcacccggcgttcttcaaaagcattagtctactttcaaattttcgtccaggatcaccagttcgccgttgcgttcaatgataccaggctgaaccacaacgattttcagaccttcctgcaattccagacactgtgaagcataaccccaaaccttgacctgatcgccttcctcaagctcaatggcagtgcttacagtaccatcttcattcaaaagctggttagaaatacagtagagctggccggttgtatcctctgcgatgtagagagacacatccgtagcgagtggcgttccggcaatagatttatattcaccgacttcttcgccccaaatagtaccttcactgtaaaatccaacgaccatattttcttcatatccctcgatgatcgcattgaaatcctgagcatacggctccatctcagcttttgtcgtatccttgtaagcggcaatcttttcattagaggcctgttcttttacttcttgcggctgataatccttgtattcaaaaacattgtccgaagcaagcgtgattgctgtgtagtcatcatccagaatgactttataaacagcaatttcatcatcatcaacagtacgattgatgtcgatatttcctgcgaaattcagttcatatccgtctacaccttccagcgccttttgtaaagctgcgttggacatagcacagttgatcccattgagcgttacaaagaaatcaggatttggttgatccttatcggcagagtattccagttctaccaccgttccgccctcagcaggcttgcatggctctgtcccggcatttacgattgcaacatccatttcctgatcgtctttggaaaattccccataaatacgctcgccgggttgcagagaaacctctgccgcatcatattcttccgtttccaaactccatccggcttgtatcagctgggaagtttccaaaggaagcgtgtagtaagtaccatccagtacgaactcaggtgtcccgtcatttttcagctgagacagaatggcctcatccgtacagcctttatcgctgcccgcagctaccggagctgatgtctgaggttttgagccgcatccggccagcatactgcataccagcacacatcctattagtaaagcaatccattgttttttcataagcgtaaatcctttctgcgattctatcaattttgttttatgtatgaacaactcatatcctatataaaggtggattatgctccaatcagcgtcatgaccacatagagtacaatcagcaggagcgcaagacacattgcacagaaaacggcaatcgtcgttttgaccctgtgccgttcctttaatgtcagaaccatcattgcaagtacatcaaaggaaaagaagaactggcagattccagctaaaaccgccaaccatttcggatgtatgccgtctttgcatgactttatcagataagcgatagcatagggagctgcccctaatagaatcccgtatccaaaaatcaaaaaaacaatggttaccagtccaaacaacgccatcagcggcaatgggaagaatgccatcagcgttacatatacggtgatgctccctccgatcaggtagaacgggatcagtccatacttgatgatcaaagtgcagttcagcaatgtctttctcgaccactttcttcctacggtcagcacaacaatcaaattgacgattcccatgataaagggcagaaggatggataatatctgcaatttgatcgcattgtcaaaacagcctgccaaaaggaagaatgtataagacacaattacatagagtaccgggaggatataagtcatttaacaacctcctttctgcgccggatcaaccagagaatcagccagatcaagcagactgggaatgagaacaagcccaaaataaaaagtccggctccaaccgatccgagtattgagtccccggtggctatattgctgatgattccgaacagtgccagaccaacactgaaagagagccagcaaaagaaagcatatttactctctttggcgcttgcgggtactcttgattctccctttttgtttccaagctgggtttttagctgttcgcttagaagtcgttcctgttcctctaatttggtgtctccgatcgcccttgcgtaatctccccgaagcaggtgataccctattttatcctgcgtattttttgctcgatgcaaaaactgctccaaagtttcttctgcttctgtccagcgctgttgttccagcagagcggagaaccagttcgctgtaatgatatttttggaatgtttgctgaatgcccagggacgccagcgatccaatccctgtttcaaattctcaagattatggtcgctttgatacgccaccacataggggttaagtttctttgccagccagtgttcatatttgcaatatgcgaaaaagcatagagcaagcagcgcaagaaacactacaacagcaatccacatagtctcgtaagaaaaaaagtgatcataaatcaggcacgcagctccagagagagccgcaatgctgaaaattggccatggatttctcataatagcaatatctccaatcatctgtttgaataaagattccgatatggttaaattgtcatatctatatgcaaacattatagcatttgcatcatctttcgtcatcatttttctactgtttgactgggaatttaatggtaaacaaattgtgaatatatctattgcaattttacaaaaagaaaagcctcatccctcgctgattgagagatgaggcgaaatgattatgctgtaatctccgggatttctccgacaaagttataaacgattctgacttcctgcactttctgtccgtcaatcttcttgacttcgcccaccaaaattttgctgatgagccggttcagcaccgcttcatccagttcttcaatggctgcatagcgccggatttctttgatgaaggtgcggacttcattttcctgttcgtcagagtggcgcatcatcaacagtaggtcttgcaggcgcttctggttggcttcctgctcttgttccagtgttgctgtcagcttcataaaacgctgctcagtcaggattccttttgccttatcggtatataggctcaggaacatctcatcaatttcacgattcctgctttccagtcgttgacattccttctgtgtctgggaggcatccagaagataccggcgctccatccggctgctcaaccgctgataaaaagcatcggcatctttgagcgcagtctttgccagttcctgaatatctttcagcacaaggttgtataaatctctggcttcgatcttgtggctggtacaggcgttcttgcccagcctgttgtaggtttggcagatataatacgccttatcaatcggttcccgctgttcgccggtaaaacggttctttccggttctgccaaccttttcataccgcacctgcatggactttccgcaagtcgcacaataaatgataccgtggaacaggttataaaaggggcaggagttgcccttcataatggttggtctgcggtcaatggtttcctgcacctgctcccattcttccggggagatgattgcttcatggcaatcctcgataatttcccagtcctcacgagggataatgtcataggtgttggagcgaatccctttctgatgtgtccggcagaccagatgtgcgcccttataaaagggattccgcaggatatggctgattcttgcacttccccatgaatagtaatttacatcacattctgtgttgctttttactctggtgatcgggactttatcatccatgagctgctttgcaatccgcatacatccccagccatccagcgccatatcatagatttttcggattaccggtgctgtctcagggtcacggatcaaatgtcccttatcctccgggtcacgcatcaaaccgaggggcggctgcccaccacaaaacttcccctgccgggaacgggtcatacgccctgccagcacctttttagaaatatcccggctgtacatatcgttcaggatattcttaaacggcgtaatgtccatttcctgacgggtcaggctgtccactccgtctgtaatggcaatatagcgtacattgtgttttgggaaaaagatttcgatatagctgccagcttcgatataattcctgcccagtctggacaggtctttggtgataacgcagccgatctttcccgcctcaatatcggcaatcatgcgctgaaaagaagggcggttgaaattgcggcctgtataaccgtcatccacataatactcatactggaacattccgtttttttcggcaaagtcccggagcataagtttctggttgctgatgctcatgctctcattatcgccgccatcctccagagagatacggcaataaagggctgtgattttctgattaacttgttttttcctgctcatagtgttctccttctatgaacagggacacgataccattataataccatgtccctgtccatgattcaactgctttacgccgctttctgtgccatttcccgatgctccaaccattcctcgaagtgttcgcaggtctgacgctcgatcagctgctcaaaggcttcccgcatggttttgtccccagaaaactcacgaaccactacaaactggacttttttattctgcttcttgtttttctccataggctacctccatagaataggggatcagacggtggctgcggcaacgaagtccggcaacggacatcaaaaaacctgtaaactatcgtctgaccctgatttcttacttttcaaatttttttataaaatctcgttgctttcgttgccgaaaacatagatagatcataaaaagcctttacttgcgggctttttctatatcaaaaccataaatttatcagcaacgaacccggcaaccaaccggcaaccatcccggcaacagaccgtccttgtcaggcgatccactcctgcggaagttccagctgacggcattcttcttcactcagttctacaaatccaccttcgttgctgggtagttcgttgccggaagtgtcccgttcccagcccttttgtctgccatatccggcaaacatccggggattggaaaaaggcttccaaccggtcacgaccgtgttcatgatctcattgatattgtggagctgccaccgcttcggctcatcaaaggtatgtcccagagcctccttgaacagctgttttgagcagaccatgtttccggtgtagtgttccagaaatccctgtatctgtccggcttcggtgtcctccggcatgaagtctttctgtacctccaccagttgacgctggatggacttgctgaatttcatggaatatttgccgctgtggtaaatgctcatagcttctgcccatacctgcaacagatacgctctggaagcgtcctcgtcctccaaaatgtgaacctctgcattctccgggtaaatcatgattgggagaaagcgccggttcccggctcgatccagcggcagaaagtccagcgtattcgaggaaccaccgaacacacactgccgaagccggtctttaggctgagattcataaggtgtccggtaggtttccttctgtcggctaataaaggaacggatttcttcaatgctctttgcgctgctggtggcaagcatctctgacatctcaatgatccagtgcccttgcagcttttggaatacccggtcgtcatccaactttttcaggtcatcagagaaccattcgtcccggatcgccagcagtcggaagaaggtggacttcccggcaccctgaccgcccaccaaacaaagcatttcctcatatttggaaccgggacggaatacccggcgtatagcacccagcaggaaatgtttcagcatttcttccacatagtcactttcatcagcaccaagaaaatggtgcagacaggatcggatgcgtggtgtaccgtcccagacaaggctgttcagtacatcctgaattggatggtaacaattttcgtttgctacgatagaaagggcagccgtgatctttttctcactggtcagctcatagtttctctcaaaatagaggagaagatatttcacatcagtatccgtcagagcgctggtattcctgcgccagcccaagtcctgtacaatgtctacccggtctgtcaggagattaagccggatggcatcccgcaggagtggatcgcagcagaacacaatccggcagttgtcgatggtgttggctgtttttcccttgtcggtaacagaaaggctctgccgcacctcatcaacgctctgttccggcgctatggcttcggctgcgctcatcacagcctgctgggtggctggcgataaactctgatattcgctgttcaattttcctcacctcttttccatactcagcaactacaaaagctcgttcttctatgctgtcagacagaagaagatccaacagatattcgatatatggctgcctgtgcagagcctccacaaacaaaggattccagtcatcctccggttgtttgggcgcatattcttctttccatcgttccagcaaacgcaggtagtcgcacagcacccgaaaacatttctgctctgcctgccggtatcgcatttcctcgctgatttttcttttgattactctcttttgtggcggatcgtggcctttgcggtcaaagctgattgagaagtcctctgccagctttaaggcagcttctttactgcttagtccaaaaagacgggaagtgaaatcaatcacatctccatctgcctgacaggcaaaacaatggaaccgtctgtccaccttcatgctgggatgcctgtcatcgtgaaacgggcaacaagccatcccgttgcgtcctactgaaattccataaaccaaagcagcctgccttgtggtaacagactgttttactgcttcaaatacattcgtttcttccacctccaaacaatgcaaaaggcatccggtttccatagaaaatcagatgcctcacaattccatatcctgttttcttgttggagcaatccgtccttcacgctcccagcgctcccggttctcccgatcagcgtccagtttgccttgtgccagcttctccttaatggattttctggctttatttttgatctgctctttgccagcctgtttgacctccggttttaacagcaccgcctgtacctttttgagaactttttcagcagactgctgtaatttttctcgcaccctactcagcagagtgttcgctatcttcacaacttctggcgaatttttggcattgggcgataccacgctctttcgatatttttcaattacttccatatcttcaagctgggtttgttcccgaaccttgtcggtcacaacctccaccgccttgtcataggctgcaccagaaacatcttccagtaaggtttctacatcctcaatttttagcgtcagttcctccagcttttgctcctgtgtcgccagctgctccttctgcttcatcaggatataatcctgcttttccaaatagtcacgcccaccataggacggctcctgttccagatgcagcccatgccgtttggcaatgtcaaataagattgtccgacagactgcatcaaaagtctgtttccggttattgtgctttccttttggctgttccggtttagggagagggatacccagttcctccaacgccttttcctgctgggggcacagctctccataccgattttcacagtcaaatacatggcgctcatggatgtgcggagtcccttcatccagatggagcgcccagtctaaaatgtggatatgagaaccgaaacggttttcaaattcctcataaaattcactgacaatgagcgctaaagtctccggcggaacggattcttccatagtgccgatctggtagatgctttcttctggacaggtcttgttatttttcaaaagatcatccacagtgcgattgcgctcaatgtgccgggttttctcgttccgggcgttctgagcattgacatggtcggcataatgctcgtagtaatacatccgttcaatttcctcaaagctgaaatccggctgctctgggttttcccgaaagtcgtgggtggtaaagccccggtaacagtcccagtacacattttgtctggcacgctcagcgtcaatgtgttcgctgttttctacatcgaaccgacggtcattgtgccggggattgtaagtgccatgcttcccagatcgtccattgtgtcttgttaatttcaaacatttttcctccttcctgcaaagatgttccgggctggggagggcggcaaagccgccagacctgcgaagttttgcgtcaggtaatacccagtacaagttgacgcaggcatcaactttccctgggcaaggcgtttcacccttgacccgatgaggctggctgccctcaacccgccaatgggcgttgccccttgaccccagcagtgcgctgccgcccctgcaccccggcacaaagggctggctgccctctgtactcccgcaccggcgaagctggccttcaccgcagaagcggtttttgccagtttcaccggctccgtatccgcacatttgcgcccataggcgagaagtggatacagaatacgcctgcggaaattgccgatcaaaacaacgggtgcagacccgatattttttcgtaaatcgccctcattttaagcgattttttcttctgtctgtatgacctgaaagccatgctcttttgcgtactcccttgcagctgccagccgttcttcgctgtacggcggcaccagccggatcgaaagtcgggacttgtccagtacataggtcacgctaccttccggcgtactgcgttccaagcggcacagcagagggtacttccggctgaaatcctccagtctgcgtttcaagctggcattgaaggtgtagatactggcaatcgtctcgccctcattccagttgatgatggtttctttttcatatttagacagcttcctcatacagttcctcctcataatcggtgtttgctttcagcgcacgcagactgcgtctaatccggcggtattcgtccatctccatacgcagatgatggtaaaaggcttcgtaccacctttcctctgtctctgtctcaattttacgagcaagatgaagcatctggcttttcgcctccgggtcaacagtcaatgctgtcagccatttcagccttgtcactgtgttgtgatggctggggcaggcgtaagcgtaaagaattttcttttccttcatattcagtttcataatgatctacctccattcatttgatgcggtatgttccgcatcgtttatttttctgtctgccggtctgtctgcaaaatattcctgcccggattctctcccagcgtattgtcctctttggtgcgctcttatcgtggcgtcacttccccggaggtcatcccccttgcagccggtcattcatttttcaaggttctatgtctcctgacaagaaccagtttaccgaaaaaagagggctgctcccgtatgtccaagacgcaggaaaaacacatgaaaaccgcatatttccacgctctcggaaatgtgctataatgaaaaacaaaaaccgttggcaaggaggtgctttgatgtacacaaaactgtcaatcccggaacggctcaaagacctgcgagtggtggataagcacctgacgctggaacagctggcagaacagaccggcctgtctaagtcggcactggggaaatatgagagcgatgactacaaagacatcagcccatttgcgattgcgacactggcaaagttttacggagtgtccactgattatctgatgggcgtgtcagaaaataaaaatcacccaaacacggagcttcaagctctgcatctgagtgacgctatggtggaacttttgagcagcggaaagatcaacaaccgcctgctttgtgaactggcgactcatccaaattttttgcggctgatggttgatatggaaatctttattgaccagatcgctgatatgcgagtgaaccagatgaatctgattctggaagctacccggcagaccattcttaaagaacacgcacccggagaaaatgatctgtatatgcggacgctggaattgggtcaggtacaggagaacgatttttacagtcatatccttcatgatgatctggacagcattgtccgggatatacgggaagctcatttgaaagacaagaccacagctgacccacagccaacactggatgaggtcaaagagaattttgaacaggccatacagatgggaaacgacacagaagctatgatccatgagttctgtgataaaatgcagattccttttgaaaaaatttcatccgaggacttttcggcttttctgcggatactgagcctgtccaaactgcttaaaaacccaaacaatatgcggggcaaagccaagccacagccgtattatatgccaaaaaagaaaaaacgcaggtagcaaaaaggccatccactataaaagtgaatggcctcagtttttccaccttctcagacgaaaatcatctcagaccgaatgacttcctctgcccggtggtgtatgctgttcatgtgaccgacccatgcaagctggtcttttgctttcaattcctccgtgactccctctgtttcttttatctgggcaatggtacaatccagacggttctgtgcctgctcatccagatcggcaagatatgtccacagctttccagacagaagtaattcattgtaccggtcggaacaatactcttgcagatattccctgtgcatccgtccccatcgtccgatggggcggctttcctccggcagccgtaagtctggaatatagtagtctccgaccagaacatagtccagaccgttactgtcatcatggatatgctttttcaatttttccatagcgacctcctgttttcgttttctccgaatccagttgatcgtgtccctgttcatctgttattcaaggcaactgaactcgtcaccatgaattatggcatatctttccccagcttttgatagttcaggccatagctgcgggaggttccccgcgtatcgctggtattgtaggtatcaatcgtttcctttcccagcatagtggacaccatcttcaaactgctttcttctttgccgcccaaaaacagcagcgacgaacagcagcccgcaatggtttccgcattgtccttatacattccttttaactggctgtatgtctggaggacgatatgggccgatatgttccttgacctgataacgctgaccaaatgctcccagttcgggattttttggtttgcaaattcatcaaaaaggcaagtcacatgaaccggcagccgcccatgatagacggtcagcgcccgattgcagagcacgttaaacatctgggagtacatcatcgccgagataaaattgaatgtcggatcgctgtcggacaccaccgcaaagagtgcgattttttcatctcccagcttttccagttccaattcatcgtactccatcatttcacggactgcctgaatgtcaaatggcgcgagccttgcgccgcagctaattaaaatgctttttagtgtttttccggcggccatcttaaatttcagatattggcggacagcgaaatggtcaggattcttttgctgtaactgctcaaacagcaggtcaacagccgatttgaagttttcgtcgtcctcccggcactcacaggcattgagcatatccagcagcgtagtcatgttcttttcctcagcgggcgcttcatagtagatgtaggcgattagtgcctgatacagcagggcttccgccttgctccagaagtcatcgccgcccttgctgtccttgccctgggtgttctccatgatgactgttaccagggaaagaatgtcggtttcactgtgcaggtaatggaacggattgtagtgcatggacgcgctgaaatctatggtgtttaggattttcagcttataatgcccttgctgcaacagcacccggcccacctcctccacaacggttccctttggatcggagcacacatatgagccattcatctggagtaggttcggtttgatatggtagcgtgtcttgccgcttccgctaccaccaatcacaagaacattcagattgacgttccttttttcagggtcggcaatcttgcccagggtcaggcgttccgtatcggtcaacaggatattttgtgaaaaatcggggttgatgaacggctctatatctttttgggtgccccatcgggcggtgccgtattcttccccgtgtcggtacttcttggcgttctttgccttgaaatagagaatggcccttaccagcacagccgcagcagcacccacgaaaagatcaaacgggtgcaggctggggaacggattttgaaagaccgtacccagcgtggtaaatgtgcccagcaccttatccagaatatccgcgccggttgtcagccggtaggcttctcccagcttggtacacagcagcccgatgataacatagggcagactggctttgagcacttgggccgcgttgattttcggcagcttcttcatcgctccacctcctgatgtttatttcgggagagggattgggccatatttttgaccacttcctgaagctgcgcaatccgtccgcgaacagagggcttttcctgggccttgcgcttaaccactttgccggaatattccgcaaaggcggcagtcagcgcgtccgcgtcacggcttttgaaaaataccagatagcgcggcggctgtgaggtggtatcctttttcagtgcaaagtcaacaccatatttccgggcaacctgttcaaaggacttgatattaccgtccgtcacctcgatattggaaacgcctgcgccctgccggacaaggtgctttacactttgctttcccttataaactttgggattcttctggcttttctccatttccgccaggcacttgcgaatggccgctttcagtaaattggcagacagtttgcccgctttaatgctgatagccacggcctttttttccatttcttcctgcatgggctatttcctcctttccggcagggtgaaagtggaaaagagagaatctaaggcggaaccaccagcctgtgcagcagaaaccgcagcagccggtggcgcaggtcagcaggcttcttcatggccctggctcctgattttcaggataccgtccaatgtggtggccgtaatgcctaatcgctgggcaacggcaatatcgttttttacggtttcgtccacctcatcaccacagacgataagaacatgactgcggcgaagcagatcgcgggccatatcaatcccgtccttgtgttcggcgggaatcgtgtcattcagaaaatgcggcagatacagaatcgggcagattggcgtgaagccagcctgatagaccttgcggcaatagacaacggcctgatcggtgtccgtaaactcctggccggtccatgcggcggtaatgtaagcaaaaggttttttcacggggtcgctcctttctccagcgttgtgccgggtggcaaatgaacggccccgtgtcaagaataaaatgaacgcgcaccgtgcgcgttcttgacacagtgccgttcatttgcagttgggtaatcaagggcaaaccggataagaccggcttgccgcccttatttgattatgaaaaaagcagttacccgctaccgtacaggtcgtggttgaccagtgcggtgtagtagctgctgattgtggtaggcgcattatagagcgccgtcaggagataggcccggatattccgaacctttgttgtgttttggtgcaggctgtccatcacatactctatgtggctggaatccagctttaagagcctgcttttgaccacctcgttgggatagtcctggccgccaatgcggatctgctttctggtggagcaaactgtgtctaccagaatttcaagcatttcatctaacatatcccggtcatagcccacacgctcacaaagatggtcgtactcaatgttctctttcaaaatctcccgataaatccgtatcgtatcaatcctatcagccgccgcaggtggtttatcttccgttagccttgctgccggatagatagatggatcggtatcattcgattcagtataattcttatcagtattgattgtctccgattttaggaagtcaagacttcccgtttccggaagtgcagacttccgcttttcggaagtcttgacttcctccctccgaatgaagtttttgacatagattttggtggggcggccctggccctgcttcttacgctcaatcagacccaccttgtccagttcggtaaaaagggctaccgctttgttgtggccgcagcccatcgcgcccatcgcttcctccagggtgaagtagatgaacacccggttttgttcgtccagccagccgttgcgtatggaaagccccatacggtccaacatcaagccatatagaattttcgcgtcgccagttgtctgtttgaaaccggggtcggtgaacaacaccttgggaatccggtaaaaggtatattgctctgcctcggtgccatagaagtattccaatgcgcccggctcggccatgttttcgccccctttcctgggaacggctgcccgaaaaagggcgcgaaaaagggacaccgtaaaaacagtgtcccttttcgtgcatgttgccttaaacccttgcccgtttagccgtctgccgtattattttttagtttccttaatcggcaccagctaatgctgtccagggttttataatttacaaacgtcttgtgtttcaaacaggatatcatacaactaacatttctatctttcacagagatttcagctgtacagcttattttctgccaaatactcaaatctaacagaacattacatcctgtcaggcgccgaaaatcccagcagttcaatacaagtctccagaatctccttcgtcagcaccagcagcgcaatcagtccggccttcttcgcctcatcttcttccgaaataatcttcgtttcatgatagaaccggttaaaggcattggccagatcataaatatacgcgcagattttatggggcgcgcattcggcgaatgcagtttccatcatggtattgaatttggcgatttccatcatcagcgccttttcatccgggctgatggcaggggcaagctccagattttcaaggctgccgccctgatcctggtattttgccagaatggatttgatacgcacgatggtgtaaaggatatacgggccggtatcgccttcaaaggaggtgaaacgatccacgtcgaagctgtagtccttcgcggcctggttggaaagatcgccgtatttgatggctgccagtccgacgatttccgcaatattccttgcttcctcttccggcatttcctgacggctttccacgattttgcggaacatttcctcatcgatgtcatgaatcaggttttccaggcgcggcacgccgccgtctcttgtcttaaagggcttcccatccttgccgtttaccgtgccgaaaccgatgtgcaccagctttgtatcgtctcccacaagcttcgtcttgcgggcgcagcggaatacctgctcaaaatgcatggcctggcgtttatcggtgatataaatcatgatatccggattgtatttcgtcacacgttcactgatggtagccaaatccgtggtgctgtagagggcggcgccgtcggattttaagatgatgcagggagggatttccttcgtatcgctttcttccttcacatcaaccacaagagcgccttcgctttcgtatgcatagccgcccttcttcatttcctccaccatatccgcaagcagatactgtacggtagattccccgttccagagatcgaattccacattcagcttttcatagttgcgcttcatatccgccacggatacgctgatgatatgatcccacagggcgcggtgtcctcttacgccgttctgcagcttaaatgtattctccatggctttttccttataagcgggatcctctttggatttgccgctggccgtgggataaatttcctccagctcggaaatggtaaagggagcctccttgggatattccccggtgaagctttcgtcaaaataaggcagctccggctttctctcctgcagctccgttatgataagccccatctgcagtccccagtctcccaggtggatgtctccgataaccttgtagcctgcataacgggcaattctcttgacgctttccccgattaccgctgaacgaagatgtcccacatggaggggctttgccacattcggtccgccgtaatccacgataacggtcttttcttcctcaggagtttccaggccgaatttatccgccgcttccatccctttaaggtagtcacataaaaatacgtcggaaaccttcaggttcagaaagcccggcgccaccgcgttcacttctgaaaatacggcgctgtccttcagcttttcggccacctcgccggctatcataatcggcgctttgtgatatttcttggcgcctgccatagcgccgttgcactggtattcacaaaggtccggacggttggaaaggcttacctttcccagttcctcgtcatagccggcctccgcaaacgcctttctcatttcctctgaaatggcatccaaaatctttttcatggctgatctcctctgcacatttatctttgcaactgttccgcttcttcacagttgcttttcatttttataatggcccagacacctgaaccgctgctttttcatagtaattcagacactgaatctttacttttttccatagcagcccatgcacctgatccttgacttcttctaaaacagctcaggaacccgaacctttgcttctttcacgctccgcctttgaaaaaacacacccgcagtagtcctggcggtataatccgtatttttccgaaagctccacggagcgtttatatccgttctttttcttgaaatccgagggaaggaaggcgacgccgtactcttctgccagtctgtttccaatctcattgagcttgtccgcattttttaaagggctgatggtaagggtggttgtaaaatagtcaaagccctgctctctggcaatccgtgcagcctcccgcaggcggatttcataacacttaaagcagcgttccccgccctccggcaccagctccaggccttttgccgccgcgaaaaaacgctccggatcgtaacggccctcttccgccagaatacggtttttgcagtctccgtccgcttcttcattcatttcccgaatcaggcgcttctgttccgccgcgcgcttttcatattcctcacgctccgtaatattgggattatagtacaggacggtgatgtcgaaatattgtcttaaatattccagcacatagctgctgcagggggcgcagcagctatgcagaagaagcttttttttcgattctttttccggaagctgccggaggagctcatccagctgcttctgataatttactttattcatttcacctgttttatagttttgcgatatctattaacgataattcattgctctttgtttccagacttcccacaagcgcccttgcggtatccaggctggtcaggcagttgacgcccgtttctatggcggttcttctgatcaggaagccgtccctggatttatcccggccctgggtgggcgtgtcgataaccaggtcgattcggtgtcccaggataaggtccatcaccgtaggggattcctggttgatcttattgacctgacgggccttgacgccggcttctctcagcgccgcggcagtgcttctggtggcgtagatgatgtagcccagcttttcaaaacggcgggcgatttcgattgcctctcccttgtccgcatcctttaccgtgatgatcatctgcttatgcctgggcagatccacgcccgcgcccaggaaggctttgtaaagcgcttcgttaaaggttttggcaatgccaaggcattcgcctgtggatttcatttccggcccaaggctgatttccgcgccgcggattttttcaaaggagaatacgggcatcttgattgccacatagcctgcctccggctggagcccgggttcatagcccaggtcacggattttcttgccaataatgacctcggtagccagatccacgatgggaattcccgtcaccttgctgatatagggcaccgtcctggaggaacggggattcacttcaatcacataaacatcttcgcccaccacgatgaactggatattaatcaggccgattacatgaagggattttgccagccttcttgtatattcggcaatggtggcctttaccttttcactgatggtctgggccgggtatacggaaatactgtcgccggagtggacgcctgcacgttcgatatgctccatgatgccggggatcaggatgtcggtgccgtcacagaccgcatccacctccaactccttgccctgcagatacttatccacaaggatgggatgatcctgggcaatccggttgatgatttccataaattcttcaatttccgtatcggaaatggcaatctgcatgccctgtccgcccagtacataggaagggcgcaccagaaccggatagcccagcttgttggcaacagccttggcttcctccgccgtatacacggtgccgccggagggtctggggatttcgcattcttccagaatcttgtcaaacagctccctgtcctctgcggcgtccacgttttccgcgctggttcccagaatgggaactcccattttcatcaggctttccgtgagcttgatggcagtctgcccgccgaactgcaccaccgcgccgtctggatgctcgatgtttaccacattttccacatcctccggtgtgaggggttcaaaatacagcttatccgcaatatcgaagtcggtgctgaccgtctccgggttgttgttgataatcacggtctcatagccttccctggaaaaagcccaggtggcatgtacggagcagtaatcgaactcgatgccctgtccgattcgtatcgggccggagcccaggaccaggacctttttcaggggctttgtttccaccgcttcattttccccgccgtaaacggaatagtaataaggtgtgctggctgcaaattccgcggcgcaggtatccaccattttataggaagcgacgatgccgttgtcatagcgcatctgcttgatttcggcttccggcaggccggtgaggcggctgattacattgtccgggaattcaatgcgcttcgcttcgcgcagcagctgtaccgtgagcggctgcatttgaagggcctgttccatttccacaagtatggctattttatcgatgaaccagtgatccaccatggtgatttcatgaatcgtatcatagtcgatgcccttgcgaatggcttcggcaatgacataaattctctgatcatccacttttttcaggcgttccttcagttcttccgccgtaagctctgaaaaatcatagctcagcaggcagtccacatgctgttccagggaacggatggccttcatcagcgcgccttcaaagttatttgcaatactcataacctctccggtcgccttcatctgggtggtcagcgtcctttttgccgtaataaacttatcaaagggcagacggggcagcttcaccacacagtagtccagtgcgggttcaaagcttgcgtaggtctttccggtaattgcgtttttgatttcatccagcgtgtagcccagggcaatcttagccgccaccttggcgataggataacctgtagccttgcttgccagcgcggaagaacggctgacacgggggttgacctcgatcacgcagtattcaaagctcacaggatgcagggcaaactggacgttgcagccgcctgtgatctgcagctcatcaataatattcagggcggcgcttctgagcatctggtattccttgtcgctcagggtctgggaaggggcgacaacgatactgtcgccggtatgcacgcctaccggatcgatgttttccatgttgcagacagtgatgcagtttccggcgctgtcacgcattacctcgtattcgatttccttccagccggcaatgcagcgttccactaaaacctcgcccacgcgggaaagccgcaggccgtttgccagaatctcttccagctccatctggctgtgggcgatgccgccgccggaaccgcccagggtataggccgggcgaagcactacgggatagccgattttcctggcaaaagccacgccgtcttcgatatttcttaccaccagggagggagcgcagggctcgccgattttttccatggtgtccttgaattcctgtctgtcctccgccttgcggatggtctgggaggtggtgcccagcagcttcacattgtgggccgccaggaagccggattcgtccagctccattcccagattcaggccggcctggccgcccagggtggggagaaggctgtccggcttttctttttcaatgagctgttccagaacttttacggtcagaggctcgatataaaccctgtccgcgatatccctgtccgtcatgatggttgcggggttggagttgacaagcaccacctccacgccctcttccttcagggaacggcaggcctgggtgcctgcatagtcaaattcagcggcctggccgataacgatagggccggaaccgatgaccattactttttttacattgggatcctttggcatcttacattcctccattcatcatcgtaaaaaaccggtcaaacaggtagccggaatcctgaggccccgggcaggcctcgggatggaactgcacggtgaaaatattttttcccgtatagcttaagccctcgtttgttccgtcgttgacattgataaaagcaggaactgccactttgctgtcaagcttgtccatatccacaacatagccgtggttctgggaggagatatacactcttccggtggacagatcctttaccggatggttaccgcccctgtggccgtatttcatcttaaaggtatcggctcccgtagccagggccatgagctggtgccccaggcagatggcaaagatcgggatgtccgtttcatacagctttctgatttcagcgatgatgctttcacattctttggggtctccggggccgttggaaagcatgatgccgtccggccggtccgcaatgatttcctccgcgcttgtaagcgccggatacacggtgacgtcgcagcctctcatggcgagggagcgggcgatgttatccttggctcccagatccagcagggccacccttttgccggctccgctcagttcttttaccagggagggcttcttttctttcttcccggaaaggaagtcttccttattaaatacggcgcttccggaaagcgggccgttatcagccagatccttcacgcccctgatttcgtatttggcctcgcaggttaccttttccaccaccttgccagtggtgtattctgccagccgcggcaggattttttccaggcagtaatctgcgttggtggttatcatgccgttcatggttcctttttctctcaggattttcgtcagcgctctggtgtcaatgcctgcaattccaggcacgccgtgtatctccaggtattcctggatcgtacagtcggagcggaaattacttggcattctggacagttctcttacgataaagccgtccggccagggtcttcttgattcgcaatcttccctgcatacgccgtaattaccaatcagcgggtacgtcatacatacggcctgtcctgcataagagggatctgtcaacacttccagataaccggccatcgatgtgttaaatacgatttcactgattatctctttttcggccccgatatgaattccttcaaataccgtgccgtcttccagtatcaaaaatgccttcattttcatctgcacatcctttcccataatcgattaattgtatcacaaatgcaaagggcgggcaatcattttttccttccggcagttcaagaaagtaacagttcagccttcggccgaactgttactgcatccacccatgataagtcgccttcggcgaggggcggatgcctgctgccaccacgttttctcacggattgcgcagtgaatgcgcaaacctgcctgaactgttactaaagaaatcccacagcagccgccgtgggatttcaaaatacatctgtttatttaaagtaagctacgcctgattcaaaaatcttcagatcctgttcgccgtaaatattcacggcaacgctgtcgcctcttctttccacatgggccatctttccgaggatacggccgtcgggggaggtaatgccctcaatagcggcataggagccgtttacattccactcctcatccatggaaatattgccttccggatcggcgtactgggttgccacctggccgttttcaaagagtctgcggatccagtcttcgcttgccacgaagcggccttcgccatgggaagccggggttacataggtcttgcccagctgcgcgccagccagccagggtgatttgttggaaaccaccttggtgtataccatcttggaaatgtggcggttgactgtgttgaaggtcagggtcggggaatccgccgtctgtccggcaatttcaccgaagggcacaagccccagcttaatcagggcctggaagccgttgcagattccaaggcagaggccgtcgcgttcgttcaccagcttcatgaccgcttccttaatcttcgcattctggaaggcggtggcaaagaatttggcgctgccgtcaggttcgtcgcctgcggagaagccgccggggaacatgatgatctgggcttcattgatggctttttcaaattctcccacggaatccctgatgtcttcggcgctcaggttcttaaataccttggtcaccacgctggcgccggcgcgttcaaaggctctggcgctgtcgtattcacagttggttcccgggaatacggggatgaatacggtgggctttgtcaccttgtttttgcaaacatagatgctgtcagcctgatacagaccggtatttacaggatctgtttcctggcttgccctggtggggaatactttttccagggttcccttccatgcggcaagcatgtcgtccagagcgatcttcacctctccgaaggtaacggcaggctctttggtaatcgtaccaatcagctcgtaagctgtgtcaatcaggttgaatttatcagcgggaacttccgcgataatgtcgcccagggagttttcaaacagttccttcagatccgcttcctcgctcagctcaacgcccagatgattgccgaaggccatcttgggaagagctgccgcggcgcccttgctgtcaagggcataggcggaaacgatcacgccgtcgcggatcatttcgctgatcctgtcatagagttccataacgctttcataaacaggaatatcaaaatcatctctttccaggcagaaacggactattttgctgccgggaatcttaaattccggagtgataatattcttttctttagccacatccactgcaaaggataccagtgtgggcggtacatcgatatcgttgaaggttcccgacatggaatccttgccgccgatggaagggaggccgtagcctacctgtgcgtcaaaagcgcccagtagcgccgcgaagggctggctccatctttccggttcctctgtcatcctgcggaaatactcctggaaggtgaaacggatcttatggaaatctccgcctgcagccacgattttcgccatggattccgttaccgcgtagattgcgccgtggtaagggctccaggaggacaggtagggatcaaagccgtagctcatcatggtcacggtatcggtctttcccttcagtaccggcagcttggccaccatggcctgggtttctgtcagctggtatttgccgccgtagggcatcagcacgctgcctgcgccgatggaggaatcaaacatttccaccagccccttctgggagcatacattcaggttggaaagcagggtcagccatgctttctttacgtcgcccgcttccagcgcttctcctgcctcgggcaccgcatatttgtcaaaatagctgcttccttccgccgggatatccacataaacattggtttcctgatgcgcgccgttggtatccaggaaggctcttgaaatatttactatctctttgcctctccaggtaagaaccaggcggggttccttcgtaaccacagccacgcttacggcttccaggttttcttccacggcatagcctaagaaggtatccacatcttcgggagccactaccaccgccattctttcctgggattcggaaatagcaagctcagtgccgtccaggcccgcgtatttcttgggcaccttgtccagatccacgcgaaggccgtcagccagctcgccgatggcaacggatacgccgcctgcgccgaagtcgttgcatttctttatcagcctgctgacctctgccctgcggaacagtctctgtattttacgttctgtgggagcattgcccttctgcacctcagcgccgcaggtttcaatgctttcctccgtatgtaccttggaggatccggttgcgccgccgcagccgtccctgccggtgcgtccgcccaggaggatgatgatatcgccggggtcagaggtttcacggatgacattttttctgggggcagcgcccatgacagcgccgatttccatacgcttcgccacatagttgggatgataaatttcctttacatagccggtagccaggccgatctggttgccgtaggaggaatagccgtcagccgcgccgcgcaccagttttttctgggacagcttgcccttcagggtatccgcaacaggaaccgtagggtcggccgcgccggtcacacgcatggcctgatatacatagccgcgtccggaaaggggatcgcggatggcgccgcccaggcaggtggccgcaccgccgaagggttcgatttcggtcggatggttatgcgtttcattcttgaagaaaacaagccattcctcggtcaccgggccgtcgccgtaatccatctccacgggcacgatgacggagcaggcgttgatttcatcggattcctccatatcctggagctttccttcttttttcagcttgcgcattcccatgagtgccagatccataaggcagatgaacttgtcatccctgcccttaaaaatctcctccctggtatccagatagctctggtaggtgctttccatgggcgtcctgtaatagccctcgccgaattccacgttcttcagctcggtggagaaggtggtatggcggcagtgatccgaccagtaggtatccagtacgcggatttccgtcatggaaggatctcttttttcttccccggcaaaatagttctggatatgcttgaaatccttaaaggtcattgccaggcccagagaggaatacagagccttcagctcctcctcgggcagatccttgaaaccgtcaaaaattttcacatccgcgggttcttcaaacacggtttccagcgtttccggctttatcatatccgtttccctggaatccacagggttgatgcagtatgcctttattctgtcaaactcgtcatccgtcagctttccggtaatcagataggttaccgccgtcctgatgataggctcttcctcttcgttcaaaaacttcacgcactgcagggcagaatccgctctctggtcaaactgtccgggcagaaattccacggaaaaaactcttccgttctccgggacctcaatctgttctctgtaaagaatatctaccggcggttcggaaaacaccgtggtgcaggccttttcaaaaacctcgtcgctgatatgctccacatcgtagcggatgaacatcctcacatcctctacttccttcaggttcagatagttcttcagatcgcctttcagttccttcgctttcacggcaaaaggggctttcttctctacatagatacgtcttacatttcccatgaatggctcctccaaatgtttgtggccggcttttcttttttcccaagcgccggctgcttggagcatgcaaaaaactatcctccgcaatatacatcagtcctgcggaaatgaattccgttacacgctccaccctgctgacagcagcctttttccttccctggcaaatcctggcgctgtcctgcaggcgggcattctcttcttattatacaaaatccgcggggtttttcaatgcaaattgttgaaattaagtgaagtttgtaagtcaggccaggctttgcctgccgccgggtgctttttatgtccgtcccacggcgaaagtcacagaaaaccgggaacaggcggtgcgaaactgtgcaggatgccagcatataccggaaattccattgccgcactccagggcgtccgccattttcctgcggattttcccggcctaacctctttcattttacagggtatcgatccccagcacatttttcgcaataatgcctattacaaaggaaatcaccgccacggagagggatgtcaccgccatttccccaaacctgcgaagaaacggctcttcctttgcaacggatatataatagttaaaaaacaggataatcagcaggaccgtcacgatcatgacgccgaaggccgccgcatacatctggttgggaaacagcaggtaaggcagcaccagaagcgccactgtgaccagatacgcggcgccggtatagacgcttgatttcaacgccttttcgttgccgtcggcgcgctccgccagatagttggaggccgccatggaaagcgtggccgatatcccggtgattatgcccgtcatggcgaccagccgcgtattggccagcgcaaaggtcacacccgcaatggctcccgtcagctccaccagcgcgtcattcaggcccaggaccatggctcccacataatgcagacgctcttcgtccagcatgccgtaaagctctttttcatgacgcctttcatcctccagcatcatggccgcctggggtatttcggacttcatgttttcataaatttccccgctgatctgctcgtccttctgcatgcgcttcaccacaaaagtaaaacccagaaccgctgacagcagcttcagccagaaaatatggaagcccttcggcctgacctcctcctttgtcaccgatttccatacgccggcatgtttctgttcatcctgcgccatttgcctgaatatcttccggttgttttcatccttctgcctttctgccagataagaatataaaacaattcctgtttcttcatcggcctgcgcctttatcactgcctttcttaattcttccttcagttccgccatccccatttcctccttttaccagaaataccaacgtcaaaaaatcaactgccgccgcctttttccctatgccacagccttctgcgtcctgttaatattttacagcccctttttaataaaatcaatcatttacaggcatcctgacgttttgtgccaatatcttaaattatagcaaaatttctaaatatttatttaatttttaatgtaattgctttttttcggtatttttgtgtgctattatgttcacattatttaagagtagattttttacggccgtccggaccattaatgcagggctgccagccacaggaaaagaaagcttaagggaatgcctatgaaatattttaaaatgtttttaaagaagctgctgcgttatgttttaaagccgctgtcctttctgccggcgcttatgatgatgtttgtgatatttaatttttccgcccaggacgggacagcctccagttcagtgagcagtacggtgagcgtaaggttcgtccaggtgtgtgacagggccctggacaggggatggagcgatgcgcagatcgcgcattatgcggaacggattgaacattatgtacgcaagctggctcatgtgacggaatacttcctgcttgccgtcgccgtatccttccccctgtatgtataccgtctgcggggctggcggctggtgcttgccgccgggctgttctgcgtgtgcttcgccggcctggacgaatggcatcagtcctttgtgccgggccgttctccctccccaagggatgtggctatcgacagcatcggtatctttgccgggattgaactgacacggctgatctgctttattgggcgaaagaccattttcaggccgctttccatcgatggaaggcaggaggaagaggaacggcaggacgatggggaggattccttccgggaaagacgggattacaggaaacctctcccggacaggggcaaacggggggcggagcccgcatacacccatcgttatacaggtgagcttcctatcgtaaaataaatggcaagataaaaggcaggttcctgaatgcaggggctttatggtttttacggttttcactgatttcgcggcgtttacgtattttcctacgggaaaacggaaacgccgttttttcatgccgtatgccatggggaggggattatttctcctgcccatacaactatgaaagtaggaaaatttttttcttctgccaaggcaggaaaatgtaagaaaaatttttattattgacatatccgggcctatatgcaacaattgttatgtaacatatgttatacatcaattttttgaaagaaggattccctatgccgcctgcagccaggataacgaaggaaatgatattgaatactgttttggatattacaagagaagcgggatttgaagcggtaaacgcaagaagcatcgcaggaagactgcagtgctccacaagaccgatttttacctgctacaacagcatggaagaactgaaagccggatttctggacttcgcctatgatttctatagccagtatgtggctgattacagcgcttccatcaaggtaagcccctgcctgctcctgcccctctcatacattgaatttgcccgggacgaaaccaatctgttcaagctgttatttattaaggatatggatttggacatggcagaggccagggatttttacagggaaaaagggaatgaaaagaaggccgggattttttcggaagtcatcggcgtggaaccggaacgggcaaaagaaatatttctggacctgttcctttattcccacggcatggcagtcttaacagccacgaaaaagttatcgttagacagaaacgctgcggaaaaaatgctgtcgaagctgctgtccgccctggtcaggcaggaaaaaccggattgggagctgcccggcgcctgatttacataaccggaaaaagccggtaaccaaccggggcgaaagctctttcagcctgctggttaaggctgtatccaggcaaactcacggcatacaggaggtatcccatgaaaacaaacaggtatttaactgatttttacaataactacgacgaggacagccggcttacggtaaagcatggctcagtcgagttccttaccaccatgcattatataggaaaatacataaagcccggcgaccgggtgcttgaaatcggcgcagggacaggcagatattcccatgcgctggcacgtcaaagccatactgttgatgcgatggagctgatagagcataatatagaagttttccgcaggaacacgctgcccggagagaacataactgttgtccagggcaatgccctggatttgtccgctttccaggacaatacgtatgatattacattgctgttaggccccctgtaccatctttacagcagggaagacaaacaacaggccctgcgcgaggcaatccgtgtgaccagtccgggaggcgtcattttcgcagcctatgttatctccgacggctgtctccttgacgagggcttccaccgcggcaatatcaatgtggcccaatatattaaaatggggctgcttgactcccggacatttgccgccagttcgaaaccggaggatttatttgagcttgtgcggaaagaggatatcgatgatctgatgtccatatttcccgtcacccggctgcattacgccgcgtcagacggctgtgccttattcatgcgggaagctgttgacgccatggatgacgatacctttgctctgtttttgaaataccattttgctacctgcgagcgggaggatcttcttggcattacgagccatgcgcttgatattttccgaaaatagccgcagcatccgcttctccggtaatttatacaaacagtatccaataaaaaaggctgcgtccattccgtttctgcagatcagaaaacggaatcgggccgcagccttccttttttatacacttacatcagctgtactgtcacaggccgtctgcctgcttttcagcaagaatcaggcattcatagggcttcagcacgactttgccctccaccctggctccatcggccactctcgtataggtatcggggagctccgcctccgcttccgaagcgttgaaattctgaaggaaccagaggttcctttccccctctctgcgggacgcggtgacgccgtagggcagttttccggtaaacgcgccgtccacattgttttcccctgccagctgtgcgtaaaaagcccgcaggaaatccgcttccgtttcgcaggccagataatatgccttgccatttccgtaccttttacaggtcagcgcgggaagccctgcgtaataatcggcctcataggatgccagcacctccgtgccggatccgggcaccacatgggatacctcgcgcagacagcctgtctgataggattttcccccgaaataaatactgttaggatgatattcgttggccgcatccatttcctcggtgcaaattcccagcacctcctccagcgggtgcctgtccagaatgcacaggtcagtttcatccaccacgccgctgaaataggtagatacatagcagccgccggcctccacataggctttcaccttagccgcatagccttttttatacaaataattcagaggggccgttacaagacggtagccgctcagatcgctgtcctcatccacaaaatccacatcgattcccatttcccagaagggcctgaaatgggccagcaccgtatccagataggccatatctcttctcggcccctggatatcctccagcgcccaccagttttcccagtcaaaaacaatggctgcctcaggccggttgcaggtgggataaacggcgtctgaaatctgctccatacgctgtcccagggcggacacctcgcggaaaacacgggtattgcttccatttctgtgatctaccaccgccccatggaatttttccgagcttccccggctcttccgccactggaaatactggacgctgttgctgccgcaggcaacggcctggagggaagaaagctcatgcaggccgggacgcttctgggtattcaccggcttccagttcacaatggacggcgtgctttccattaaaaggaaaggcgcctttttcagactgcgcatcagcgtatggcaggccgccgcccgcactgcgatatccacctcgtcctttttactgtgccattccggataggaatcccaggaaataatatccagctggggcgcgaacttgaagtaatccagaggcttgaaaaattccatcatattgatggtgacgggcagcacgctgtatttgagcacggcatggatttcttccttacagaaatcctggatctgatggctgacgaaacgcttccagtccagattcaggccgtgcaggccgttttctccgttgggcacagggctgtggatctgggaccagtcggtgtaggtatggctccagaaggtggtccaccaggcatggtttaagttgtccagggttttatatttttccttcagccactcgcggaaagcctgctggcaatgcgggcagtgacaggacgcgtcggatccgttgccgccgtattcattggaaatatgccacaggatcacgccgggatggtttcccagatggcgggatagctcgtggttgattttcttcatctttttgcgcatcataggggaggtataacagaaattgtgtctcctgcccggcagattcctcacgccgtccggccccatctgccttacctcttcatatttggccgtcatccagtggggcattgcgcctgtgggtgtggccaggatggtgtaaatgccgttttcaaacaaacggtcaatgattctgcgcagccagccgaaatggaattccccttcctccggctccagcttcgcccaggaaaaaatccccagggaaacgcagtttacgtgggcctccttcatcagccggatatcctcctccagcacctgggggcagtcaatccactgctccggattgtaatccccgccatgaaggagatggggatattttgtgataatttctttcataatgcgtcctcctctttctattctctgtcagcatctgccgcggcatttttatccattcgctccggccattctcctacaaacgccctgcgatcagttcctccagcacctcatttacccggctgcattccctgtcggcgcattttttcacatgctccctggccgtattcatggcatagctcaggcccgcttccttcagcatggccatatcgttttcactgtccccaaaggcaagcacctcttccaggaaaaattcctcctttgcggccaaaagcttcagggcgctgcccttatccactcctttgttggtaaaatccagccagccgtttccgccgtccaccacattcagatacggatcatatttttcatggaaccaggcctccttatcggcagggattccctgcggaaaaaaaatggatatcttgatcatgggaacgggcatttcttcaaaattttccaggacagtcacctgattttttaccttttcccgcaggagaaccgggaagcggggatccacaggcaccaggtaggaggaatccgccccggataccacggtctctgtcccggaaaccgcctgcatgtccgcaatcagcggcagggcgatcctcctgtcaatctcattctggtacagaatcctgccgccctgggcgatcagcgccccattttcacagatatagctgatttcatccgccacaggccaaagaagcctgcgcaggttggcatactgccttccgctggcggcaataaaggaaatgcccatggatttcagttccctgatgagcgggaaatacacctcgtccacatgctgcgcgccgtcctttaaaatcgtgccatcaaagtcacttgcaatcactcgtatattgtctgtcatatttttcccttcttattattgcaggcaggaaacggatattgctaatctttcctgcttaaataactgttcagtcccttcacagttatttaatattctactatatttataggatttccaatagtatttttttgtaaaattttcttaaaaaggggcttgcttttcccctgtatgctatgctataatacaattcgtcggttcggtaagagctgattgtaggagcatagttcaaaggtagaacagtggtctccaaaaccatcgatgtgggttcgattcctactgctcctgtaaaaaaagcctgagtttctcaggcttttttcttttgctgttttacttgaactttcccgcttctttatgagtataattaatccttccgcagccggacacctcttttggcgccctccttcactccttcacactctcttcaaccagcccataatccccaagcacctgcagcagcctttccgttttaacactatccatatcacacaaaggcagcctgcattctcccacatcataccccatagctcgcatggcctgcttcacaggaatcggattcacatccataaacagggcctgcatcagttccagatatttcagctgcagccttttgctctcctcacagttcccgtcaaaataagcctgacagatgtcatgggtttcccggggcagcagatttcccaccaccgaaatcaccccctgcgcccccagagccagcgcagtggttatctgatcgtcatttcccgtataaatcgtcaggttttccccgcaaagcgccgctatcccggctatctgtgagaaattaccgcttgcctccttacagcccacaatactgtcaatctcactcagcctccggtacgtctccggcagaatattcacccctgtcctggaaggcacattatacagaatcaccggcagccccgtggcctgtgcacaggccctgaaatgacggtacagcccctcctgggacgttttattataatatggcgtcacatgaagcagcccatccaccccgattttctcacactcctgcgacatccagacagcatgggccgtattattgctgccagccccggcaatcaccggaattcttccggcaatctccttcaccgcaaattccacaagctccagatgctcatcatcatccagcgtggcattttcccccgttgtcccggctaccaccacagcatccgccccgccgtccacctgcctgtcaagaagctttttgaacaccggataattaatctccccatcttccttcatcggcgtaataatcgccgtccccactcccctgaaaatcactttcttcatatccgctcccatccgcgcgccgcacccggtccgcttccactattctaactctttataaatatcataatgcaaaaatcataaaatgtgtgcctgaatttattatttttattacccggcagcagaaaatcacacattccatccattccgctcccggtattcgctgggcgtcatccccgtatactgcttgaaaaccttgctgaaatacctgggattatcataccccgccatagcacagatatccgcgattttatcctccgtcccgtccagcagctccatcaccttttccatccgtacctctgtcaggtattccacgaaattttttcccgtcttttccttaaacaggcggcttaaatagttgggatggaggaaaaactgttccgccagtgcattcagggacagattttcctggtaatgtttgcggatataaagctgcatctcccggatcacacccttccccagctgctggtcgtccgcagcgcccatccgctctaccagccagttaacgtaatcgcccacacagccggaaacgctgttgatatcgctgcttaaaaggattttttcaagtgtccggttcagctgaccgtgcagatccacatcctgcagcttcagcccctgcagcaggccgttcagctcaatcagacagcggatacacagcgtctgcatctgggccagcgtcagcggctttttctccaaccgctccagtgcctccataagctcggggacagcctccgcccgctcactgggaccggtaatccggccgtaaagccgggtaatcagctccgtcacctccggaatgctctgggaaaacagggcttcaatatttttataccagatgacgccctccttctcactggcccggtgatagcgcagggcctgccccgcttcctgataagcctccctgagatccccgaagccgtgtttgattttgctcacgccgcaggcccattcccttttcatatcaacgctctgttccagtatttcaatgaaatactccgcttcctcctccccgcggcagggaatgacggcaaaaaggccgtaactctcattattaagcacaatcgcccccggaacaacaccctctgtcatctgtttaagccattccttcttttcacagatttcctgttccggaagttcttgatccaaaaggcgcacagccagcccgtaccattgatccggcatggtaatcccgtaatcctccgccttcacatccccatatcccctggccgcagacaaaagaagcccctccacccggctgcttctcaccgcattgtcctgtcgccgcttcatgaattcctccctgagcctgtccagaagcccctccacctccttcagattgacaggcttggtcagataatccgccgccccgtaacggacagcctcctgtgcataggaaaattcgctgaaaccgctgagaatcacggcctttgtttccggatacacactgtgcattaccttaagcatatccagtcccgtctttttcggcatacggatgtcaaggaagactatgtccaccggatggcgttccaggaaagccaggccttcatccacactataagcggtgcccgccacctgaaagccatgagcctcccattttacgaactgggcaagccccctgcacacaatttcctcatcgtctataattaaaacctcataggcctcagtcattcttctctgtttccttccatattttccgattggtatcttaccggcagggaaatttccacctctgtaccgaattccgccctgctgttgatgcgcagcccgtactcctctccgtaaaacagacgtatcctctgatgtacgttggccaggccgatactgccctcctccgtttctgtccgctccatggattcccgcagcagctccagctcctgttcatccattccctttccgttgtccttcacataaaggagcagcttttcctccctgcagaaggcgcggatgcggatggaaaaaccatggcttccatcctcaaaaccatggattaccgagttttccataataggctgcagtataaactggggcatataaagcctgttctcctgcgcctcacacttgatttccagcccaatcttttcagtatgcctgaaattaagcacctccagataggttttcgcgtgctcaatcccctccttcagggtgatggtattgcccccggcgcacatacccatcctgcacagctggctgaacttctctatcatctgtgtcacgcggctctccccgcccgcctcgtacatcgcctcccagcggatgatgtccagcgtattatacagaaaatgaggattgatctgcatcagcagcgcgctcagctgcgcattcttccagctgattgaaatctcctgcctgcggatttccgaccggtacacctgctctatcagctgatccgttttatcggccatttcgttaaaccgttctcccagtaccgtaagctcgtcattcccggaattgggataccgggccgtccatttcccgtctcccgtttcctgcatgacctccaccaactccttcaccggatcggatatgctgactgtcacataataggaaattacaaaacaggcaaccactgtaatcagcagtacaaggatacaaaggttcctgatatgatgtgttcccgcaaacaaaacatccatatccgcaaaataggtaacaaacatcccggtgcctgatacccgttcaaaagcaatcagcacctttttcccatcaattttctcctctgtgataccgctcttctccttctccatcatttcatacagatggctttccttcggaaaggcgggcgcctgaatactgggattatagcttagcagcacgccgtcccttccaaccaggaacgcatttccatcccggtaggactcgtacccttccattgccccggaaaacgccttcaggtcgatattcataataagaacccccagaaaatccttatcaatcggaccatagaccgccacacataatgtaacgatattgcccagcccatagatgctttgctcatttttataaaaagtccaggtctgttcctgggaatcaatccagacaggataccccttcttctcctgtggaagcagataaaaatcggactgatagaatttctccatgtctttgatgagcccgccccgggtaaaaccgctgccctccaccatacgatactgctccgtcggggaaacaaactggatattcacaatatatctctgattcctgcgcatgttataaagccggttttcaacgctgtaccggtttctggcataccggtcattttccggatcgacgccctcccgtgcaagcgcggcattttcctgcagcgccgcaatcacctgggaattatcataaaaggcaagagcttcggtttcatacgcctcaaggctgtcctgaattttcatcttcacattttgtacgagaagggaggcataacggtctatattatcgctgatttcatccgaatatttatagaagctgaagaacgtgagaaaaatagctgttgtgagaatcagcagcagaaaggaggaattaagccttttaaaaatgctcaccctgcgcagtattattttgatcccgttatcgcagcgccgcttaccggcccggataccctgcagtatcttcatagattccctcccctgcctgttatggaatgattatagcatatccccttcaaacaggaaaagcgcaagaataaattcctgcacttctccagagggactgcgctaaaagctgtccattatcttttatttgcttcgttaaaggccggcagcgcttcgctttcgcactgtttctgtgcttctgcaaattccttttcagggtcagcattggggtcaaccagtatcttctgtaccgcacggtctacataagagccgaagtctgcttttccgtagaattccaggcgtcccacggattttgcttcttccaggacggttttgtattcctccgggaaatcatagaaatcggtaacgctcatatcatccctgggaatgataaccgggttgggagcgcccttggttgccaggttttcaaagtaagaggacagatattccttgctgcagtaatatttgatgtactcccaggcagcatcctttttcgcctggtctattttcgcatttatgacataacagattcctgcaattgccgtggtacgatcttcggaaggtcctgccggaggcagagacagcccgatatcatccgggtcgataccgttagccgcagcctcggacacccagtctcctgcaaacggcatcataccgattttgccaaggccgaagttggttacaaggtcgctgaatttcagggtaaggtcgctctggagaacgccttcgctcctcagtctctggtaatattttgccgcttcaattactgccggatccgtaaaggtcagttctgcggtgccgtcttcattttccttggtgagatcgccgcccgcctgccatacataatactggaagaaccattccgtccattccgccgccagtgttgcataaccggtaatctgtttatcgggattatttataagcttggcgtcttcgattgcttcgtcccaggttttgggaggttcgctgatgcctgcttccttaaacagagccttgttataaccaaaaagcatgggcgctactgatgaaggcagaccatacagtgttccgtctttggtaaacatgtcggtatactctttggtgaaattcccccattcatcccagttgtcagtgtactggttcagcggctccagaatgcccgccgccataaaggaattcatcatggtaaaggaacagtttacgagatccggagcggtgcccgccgccactgcctgatagaattcatttccgggatccccttcctttactaccttatttaaggtaatccagggatgctcctccaggaacttgttttccatttccgtagaccagtcgtctgaattacggcttgtcacccacagtgtcagctccaccggctccttttcctctgatgcggtttcctttgccgtagttccctgcgccttgctttcttccgccggcgtcgcctgttcctgcgattcctttacggcgggcgccgtattttccgttgctgcgggactgctgccgcagccggccagcgccgacgcgcccatgcacagacaaataaaagctgcaattattttctttttcatgaagccctccttcttgtcaataaatatgacttgttttcgttacagttatcataacaaattcattctttgctgaaaatgatccaaaactaacgggtttcaaacaggaaggtcaccttttttaaggtataatttctttttttcaactatcttaagaaaagtgaccttacggtgtaatacgcttatttccagcggcaggcttcttttttataatgaaactgacgctattgcaaatatatagaaccggaggtttcccatgaaaaagaacagttcccttaaaataccgggcggttatatgttccggaagaaaataactccctggtgtatccttgcactgcccatggcttttaccatatggctgaagtactatcctatcttcagcgccttttttatttccctgttccgttatgatcccatcaatccaccgggacagtttgcagggctgcagaactatatcggcatgttcggcatgcagcattactgggatgcctggaagaatacgtttatcttccttcttctacagatttccatgtgctttttcatcccgctcatccaggcgcttctgttaaatgaactgatccggttgcagaagtgcctgactacattatatatcctgcccgccctgattcccacctcggtaaatgtaataatatggaaatggatctggcatcccgattacggcgtggcaaatcaaatcgtaaagtttttcggcggacagccgcaggcatggctgagcgacccggcgctggtaaaattctgcattatcttccccggcgtcctcggcggtgggcttaccgtgcttttgtacctctctgccatccagggagtttccccggacatcatggaatccgcctccctggacggctgcaccggttttggaaaaatacttcatattatcctgcccaacatctcctttatgatttttatccagctcatcatggccgtcatcactacgatgcagcttctggacgccccatatatgtatgcgtcaggaggtcccagcggcgcttctaccacccagggcatattcatttataattccttcaaccaggatctcaattacggcagaggctccgccgcttccgtcatcctgctgcttgtcattgcagccctgaccatgcttcagatgcattttgaaaaagcggaaaaagaataggagtgtgaaacagatatgaagaaaaacaagtccgccagaagaagaaaaatcaaagtaagcggctccgaacgccgtctgaaaatatgcgctgttgtgatatcactgctgttcacggtcctcatgctctatccgctggttttctccatttccagctccatgaaggacaacagccagatttatgaaattccgcccaggctgctccccaaccgggccaacagcctgaccctgaccattgactatactggcatggattttgcagatgaggccgcgctgaaggatgcggtaatgcaggacaacattctcgcaatgttcggtatcaactacaagatggcggatcagtccattatggaaatccatgtctatgccacacgggacggaaagaccattttccattccagagcacaccagatgaagctgcagatggaacgggactatggcatctacaaaagctccgctgtaaaaaaagaagtgcttctccacggggatcgttacatacgggcctgtgattccatcggttataccttccgggcagacggcatcgggaccgatatcacgccggcacaggagccagagcttttcaatcaggtatccggcatcctggcagaaaaatatgcccttaccggcacgctgaccggcgtcagccataaggtcaataatctgctgaacctggaaagcttcaaatattatctgcagatgcctgcctacatctatccggaaagcagtatgatcgtccggttcggcttcatgacctttgtcatgaacagtatcatcgtcatcggcttcgccatgatttcccaggtgattctctgctccatctgcgcctatgtcatcagccgcctgctcacaaggaaggccgggaacttcgtgctgctgttcttcatgggagccatgatggtgcccttcgccagcatcatgctgccgcagctgatcatgtaccgccagctgggcgcttacaacaattacgccgctctgctgctgcccttcctttatccttacggcttttatgtgtatctgtacaagggctttttcgaccagataccaagcagttattttgaagcggcttccattgacggcgcaagcaacttttatctgtacagcaaaatctgcatgccgctgtccaagcccatcatttccctcatcgccctgcagaccttcatcggcaactggaatgattttttctgggcctggctggttacggaggaccagaagctgtggacgctgaacgtggcgctttacaatatttcaaataatatgggcacgaagcaaaatgccatcatggggctttccgtggtgaccatcgcgcctgttattctgttatccatcctgttttccaagcagctgaagcagagtattgtggcttccggcgtaaagggatagaaggcgattaatagtcccagaaaaaggcatggcaccggcgccatgccttttcgtatttttaaatttagaattcacatggcctttttctctgctgctgtcacaggtatgcacatgtcccggatgataaaacagcatctggctttgcggtatctggctttgcagtatccggctttgcgttatttcaccctcacttccctttccaggctgccctgcaccttcacgatttcttcttcaccgttcaggctaagacaaatcctttcttctttttccagcgtcacctccacccggatatactcttcctttctctcccagtataccctgcacatgcccgccggggtcagcgtccggcagtccacccagtccacgccttccgggaagcagggctgtatccggatgcgctctctggccgaagcgtccgcccggatgcctgccagggagcagtaaaaccattcctccgccgcgcccagcataaaatgattctggctcatcacgggatgctccggattggggccgtcccagtcctcacacagcgttgttgcattgcagctcacctgataaccgtagcttggaaaatccgttttcataaaattttccgcaatgatatcattcctgccgtactttgccagcgcgcgcaggatataaggatgccccacatcccctccggtaaaatggccgccctttaaacggatatcctcttccagattctgaagcaccggctccctgtattcttcctccggcagttccagaaacagcgccatggcattggccgtctggctgccgttagcatagtttttggacagcggatagaaaaaggcttcattaaaggccttccggcagtcctgcgccagcttccggtaatgctcttcctcctctttcctgtccagcacacccgctgtttcggccataaccgtcagatcctgatacaaaatggccgtcgccgtaaccggtatgggcgtattggccgggtgagacggataatgtcccacatccagccagtctcccagcccgtaattcaggatgccgttcctggcttttgacagcagataagcaacgtatctttcggacagtccgtaatgcttttccaacaactgcatatcaccgtattttttatacagataccagggcagaagcacgctggcggagccccattccggggaatcccggaagcctagatcaaactgtacgaattccgggcagatgctgggcaccaggccctccggggtctgggaatcctccatgtcatccaggattttttcaaacagcttctttgcatcgaaatcagccaggatgcccgggccgatcaaatgtgtttcctccagccagcccagcttttccctgtgggggcagtcggtgaaaacactctgcatattgctgcggattgcccccacgatgatttcatggattcggttgtacatttcattggagcacttaaagtaaccggtttcagggcaagacgcatactgctcctgcccggtaacctccaaaatccgggcatccgtccggatcagggcataccgctggccataataggtaaaacgcggcatccaggtttcttccccttcccctgaaagggtatagacataataatggggatctcccgtaaactcctggttgatgcttccgtccccaagaagcagctcgcccggcgtaataataacctgctgccccttttccccggcggccttaatcttaatgcgcccggcaaaattccttccgaaatcataccttatccttccgtccttcagcctgcatacctccacggcttgcagctccttctgaatccgcacctgcggctggccggccttcttcagcgcccccacaggcccctcatagattgcagcgggaatccactccgcctttccttccgatatggctgccttccagccgcagacagacgcatcataatcctcaccgccgtaaatgcaggacatcatcacaggccccggacagcagctccactctccgtccgtgacaaattcctccgcagttccatcctcataggtcacacagagcgccataatcagcagcggatccccgaaggaaccggtgaatttcacataccgttccccatccacatgatacatgccgtttccaatcatgacccggagcctgttttttccccggttcagaaaagcagttacatcataggtgctgtaaaggcaggttttcctgtaattggtccagcccggctcgtaaacgccttcgtttacttcctttccctccacgaataatgcgaactgccccaggccgcaaatgtgaatttccgcctttgcaggctgctttttaaggaacaggtcccgtccgaacaccggcatctgctttccatatctttttgctgtaatccattttgcctgactccaaattcccattactttttctcctgtttcttttattccttttccataacttttacaaagagggcgttaacttcccctttgcacataaagcattcctgcaacaatccaggctcaggctgcattcctttataatcatattcctacataattaaaaaggcctgtttcacccgaatggcacagtcataggcaaaccgctggatttcccattcgtcacgctcctctgccttctggctcctgtaatggcacagctgtgccgacaagctgtcccacatcggcaccagctcgcagggctccagaatattgatgcagtactctgcggcttccagaatctcatccgtgctttttgccttgctgacgaacatggctttattttccagcttcaggacatcttccaccgcttttaccgccttgagcgcatggccttcccggtttcctctggcaaggattctgttatcgccgcagtttcttctgaaaccgtacagcgcagccacaatacccggatcccggattgtgccgtccgggtatacaagaccgtggatttccccccagaagccttcaatcatcaggttgaaaaggaaaaagccgcagtggtatttgtcacacatttccagctccaggtcataggggttggccctgccgatacagccggtttccgtgttcaggatcggcttgccgccttctgcttccgataactgaacggcagtctgataagcggcttccatcctgcttctggtaggcatgtagtcatggaagctgagtacgtcaaccagatcggacgtggaatccatatgggatgacagttcgtggcctaccgtaatcggtgtgtccggatccagttctctgatcaattcacagtgctttcttaagtcctttgccagtttttcctttttccggggatagtcctccggggaggcgcttcccagataggtattgcaaaacggttcattgaaaatatcccacatcagcagccctttctttgactttaacagacaaataatcgcttcagcataggttctttttttcttccattcctcttcaccggcttccgtataatcctcaataaaattgccgttccagaaaataggcatgatgccgattcccttttcctcacagctgtctgtaaaatcaagcagcattttctcatatgcctccggattcttttcccattcctcctgggacatccagaagcggacggcattcaggttcagacgcgccgcatactccagctgctgagccatttcctcctttgtctggccggccttagggttgtggcataccccgcgcagatcactgtagtctcccttgattcgatctttccagtctttcattttgtttctccttttcctgtggattcttatgctatgatactaaaaattcttttcatatgtttactgataatattatagcactttcctgaaaagaaggaagctgaaaataaagaaaaggaagggaggactgctctggcccggaatcaagatggatggtattagtaataacttaggggtcttttccaaaatactttttcttattttaattataaaatataactttttcaaataattttcattatataattgtatcttttttctaaaaatatgatataatatcaaaaaaggagataaaactatgtttacttatatcaaactcaaaaactactgttccttggttgattttcaggtaaatttcatgggaaaacgagacaatcccaaaaagctcatactgatttatggtgaaaacggcgtagggaaatcgaatttagctaccgctttttttacattgtatgaaacattaagaactatgtctataaaagatatgttggaaaaacttcgtgaatccgtatcggatgaagaattcgatgatagttctttccagaaattcatgaagcaaaatctgaaagatattgaatcaataattaaaagttctaaaacaatcaattcacaggattccatgcttttagaatttggctttaaactaaatggaaaaaaaggtgtttaccgtattgaaactgataatacccacattatatctgagcatcttgactttgttttaaataaaaataaaacagtcttttttgatattaatgagacaaatgtctggattaatgacaaaatttttaaaagttcagattataaagaggacatcaatattttaataagtaaattctgggggaaacattccttgctttccctgcttgtctatgaaattgaagaaaataaaaaaggatatgtaaaagcccgaatctgcaatgcattgtttgatgtcatctcttactttatgacaatgtctatccgggttaaagccggatatcgtgtagaaagagggaaaatgggaatatcccatgaaatacttggtgctttggataagggtaaaatctcttctttggaaattcatgaacttgataaagcagaaacgcttctgaatgaattttttacacgtttatattcagatgtcaaacaggtatattacaaaaaagaattcacagatgacgaaataacgtaccatctgatgtttaaaaaacttatttataatcagttagtagatatagattttgacaaagaatcaaccggaacgcagtatttacttgagataatcccctttttcatgtcctgtgttgaagggcaaaccgccattttagatgaaatggataccggaatacatgatttacttataaatacggttttagagaatctttatgattccatagacggacaaatcattatgacaacccataataccatgctgttggaatccgatttaccggatgaatgcttctatatatttagtgtcgatgaaaatgcaaacaaagaattactcccattaagtgcttttgaggaacatttacatcccaacctaaataaaagaaaacgttacctgaagggaatgtatggcggcgtcccgattacaatggatgtggattttaatgaacttatgcaaatgatggaataggagggtacaatgacaaaaactctctcctatcttaaagcagtcgtaatatgtcatggtaagtccgaaaagcaaatgtgtgatttcattaaatcaaatctacgaataagaatcgcggttgaaagtgataaaaagggcgaaaagtcaatacaggtcacaagcgtaatgaaaatattaaatggcagaaaattcaaaacttttcaagattttattactacctatgaggatgtggaaatttgtaaaattaagacaaaaaaatttttaactgatgattttaaaatctttattattttagacacagatgattgtaatgaagcacaaaagaaggcctttataaacaaagaaatgttcagaaatcattgggcatatcgatacatatttccaatatataataatccgcagcttgaatctgtcctgacaaaatcgcatattaaatttgaaaaaaagggtgatgcacgaaaacaggagtacattaaaatttttcctaccgaccccaaatatcaaaggcgagaagtaatccaggtaaaagagtttggcgataatctccgaaaaaacccggatacgaatatggaggaatttattgatttctgcctgaatttaaaaaatacaaattcttagcaacttttctccttggtctttcattaactatccatcctttagagcggaacgggggaaggagactgccctcttccggcagttttccttcccccgttccgattctgatttcatatatcagcttcattttactctgtctcaaaccctctttcagcaatcatttcccggtaccacagagcgctgtccttcaatactctctcctgtgtctcaaaatccgtatgcaccagtccgaaccggtaggtatatccggcgctccattcccagttatccaacagggaccaggcataatacccccggatatccgcgccttcttccatggccttatggatccagcccaaaaatcccctgatatactgtatcctctgctcatcatgaatcctgccgtccggctgcaccgtttcattgcagttaaaggtcccgttttccgtaatataaatgggaatgccgattttataagtatcattcagaatatgaaccgcatcatatacggcctttggataatattcgttcccattatccatataattcccgccaagattcatactcctcttcccgccttccccatttccggccgctttttccatcagccccggttccgcgcagtcaagcaccctgttatagcagttgagcccaaagaaatcaatcggctgggaaatcagcttcatatcctccggaagcatctgcggcatactgtctgtttcctccatatacgcaagcagggcatccgtgtagcagccccggaatatagggttcagataggaacggtaggctttttcattttccagctccgcaagccttctgtcctcttccttttccggccggaagggatggtgatgccagatatccaccacaataccgatctgatcctctcccattccctcttcccggaaccttctgacgccttccccgtgcgccatcagaatatgatgattcgcctgacgcccgaaagcctcgccctttcttcctggtgcaaaaccgcccagcgcataccccacataagtcgctatcggttcattcaccgtcgcccacagaggaatggaatccttgaattcccggaataaaagagaagcatactccccataccaggccgccgcatccctgttcagccagccgcccctgcgctccagctcatagggaagatcccagtggtacagcgttgcattgggcaccagaccgtttttgtgcatctcgtcaaccagccttttataaaaatccagccccttctgatttacccttcccgttccttccgggaaaatccgggaccaggaaaaggaaaaccggaaggaattggtatgcagctgtctggctagcttcaaatcctccggataggtatgatacatatcgcaggccctgtcaggcaggcttgcgtcgccgatggctcccgggatccgtgcaaaggcatcccagatggacatccctctgccgtcctcaaacgcgcctccctccacctgggccgcgctggtagcggttccgaacaaaaaattgtccgggaaagttatttttttcataccatttaatcctcctgcctcaccttttattttcttctttcgggctattctcccctgaaaacctctttcaacgcctccagataaccatacccatacaaatcatccggttccagatagctagtttccgtccattcattccagctgtttaccgtgatcagcggcggctgtttgggatggctgtcggcataggcccgggccatttcaaagccttttttaaccgcctggggggaattatttttcacaattccctgacgcagcccggtaaatctgggattgttatcccagcccaccgaaatatgtggaaaatagggaatggcataatcccgcccgatttcttcccattccttctccacatccgcaaggatgtcctcatagtcccggtcaatatccgtaatatgcacaaactggtaatgagtaacgctggaaaaaccaaggaaggtgccgatatcaccgcctgcttttgcgctctctttgtccaggccggaaagattgggcacgccgccgtgcgccgtcagctgcaggtgaagccctttaaatccggcttttattgtttcttcccggaaccagttcagcgcgtccctggtattttccagaccgcccagcccgtcgatcagaatccccagttcataaatctgaaaaacaggttccccgtctatctggtaataattgggctgtacaaaatacttatggattatcctgcggcagatccgctcaaattcctcccggtctacgccccctttccagattgtggtgtcctgctcccaggaaagacggatatcccaggtataattcacatcatggttggcccacatgagatagaacttcattttatcccggttcttcgcctgcaggaagccttcgttcagacagttttccagataaggccttccgtcaaaccagtaccagtcatatatgaaaacattgacgccgtgatccactgccgcctcgatttccatttccatcacataaggatccgcctcgtccacatagccccacagaggctttctcggccagctgtgccccggaaacttcttcacggcatttttcacagactgccattctcccatcccttccggccagaacatcaggctccttttatcccgccctgtataggcgggccagacataagccgccacatcatattttcccatagtccccatttcctcctgcaaccctttattcaggatcagttctgctctgatccgtcactcttccacatactccaccttcaccggccccaaaagccccgcaggctcctgcacccaataccggtcaaaaacattgtcatgatgcgccttggccagtgtattcgtcacctccgccaccagttcattttccccatcctgcagcatcccttcctccagaaaaaacagataaggcgggcagatggcgtctcccgccttccgtccattcacccacacctgtacagcctcgtaagcctctcccagggaaagcacagccctccctgcccttgcctcaaacttcatccggtaacggacggtgcctgaaaattccggcagcttgtccggtgcggccagactgcccgtttccgtatattcagtcctggtaaattccggccaggccagcggtccactcacgctgatttcccagcccttcgccggaagttccaccacttccccggtttttcgggcatacatccggcggttcttcccgcatttcacacccgtttccccgaacactacaaaaacggattcataggggcgaagcagcagggacaccactgttttttccccgtccttccccactttccgtctctgatgtgcttccagaaactcccccgtcataggatcgtaaaaacatgcctgccgtccgtcccggaaacaaacttccgcttcaaccttctgaaaaaggctttcattggtcaggaaataagaatccctctccccctgtctgtaatggtaaaagacaagatattccccatagcttcccccgtcctcaacctcgatgtcccgcaaatccatttccgtaagcatccttgccagctcatcataagccgccttcttcatcccgcagacaggctcgaatttttcccccagatagcttctctttggaaaatccccggcgaacaccaccacaattccctgggccgccagctcctgcagccgttttgtcacctgcccgggcagatactgcgcataaggaacgatcagcgcgccgaagctttcctccgcgattttcagccgcccgtcctccacgcggctgcgctcccggtccaccagccagtcccccggcaccacgtcacagtcaatctggcgcagcatcagcgccttcaccgccttttcaaagggatcgcacgcccctccccactcactctccccatgatacagcacggccgcactggccacgtgcacgccgtcacagagccgtgcgcacacccggttggcataatccgcccacacggaaaacagccggaactgagggttgttcccgcccgcataaaaatgcggaggacaatccggatccggaaattccatcggggaaaaagcatgtggaataatatggtttatccccctgacgcacatggcgtcagtaatccatttcatcgtcttcagcccttccgaccatccgtaggccccaaaagcctcgcagacagagtttccccgcttgcgcggatccagatgggcacaggagctggccatcttggaaagcccccagtgattaaattgcgcatcataattattgaaatgcgtcaggaacctgccgtccctcctgccgggatagatattgttgaccacatcaattcccgccatatccatcccgtccatggccctgaaataatgacccggcccatagcccagccttgcatggcttccgttttcctcaatcacatgccctatcagccgcacaccgtgttcccggcaccagtctcccatctgcccgataaaattctttccgaaccgccgggataccacgtccatataccgatatctgacatccgccgtcctctccccgcagtcaaaccaaagcgccggaagcagccggacaaagtccgaaaaaaaaacctccaaaagaatccccgcaagaagaactcccagaaaaagcttccccgcaaccagcctccccggccagttcctcaagcagcgtttccgaccatggcagcaccatatcgtcccctaacagcctgtcatagcccggactgttcccaaaccgcggctcatccgtaaaaaagccctgtatggtatccccgaaatctgcgcccagatgtctgtaatgctcttcatataccaaatccagaaaagccctggtcccctccggatccagcggattcagataattcttcgtccactcctcccctccgttcccagtcaccttgcatatgaaaatccgccattccccttccggaatatcccagtacagaatcccgtcctgcacaaaaccggtcacatcgatcagggaatccatggagaacctggcatcgtgatccagccgccggcccgccacagcgcacaggaaccgttccccgtcctccagccactgatcaatgaggactccccgttccctggccggcccgatggcgtccacatactgcaccgccagatatcttttcatatactggggataccgttccccaatcagcccgtttgccgttccgctgggatagcttccgtcatcaaaaatccacatcttaagccccagccgctttgcctcctgcacaaggagttccatatcctcccaccagccgctgcccaggtaatccggatgcggcctggactccgcaatgaatcctccgatcccgttttccttcatctgccgcagttccctgcgcaaaatttctttatcctcatgatgctgccagaacaacggacacagataacttttttctgccgtcatatttactcccccctgcgtcaaaacgcgcattcaaatgtaatttttcagggctgcttttcccggaaaattatcaaaaaataacaccgccccctgatacatatttataatgaaattacccagaccctgatatatattcacaatgaaaaatactccagcccccctgacatgcactcattttaaatacgttttcacagatacgcaagtggcaatttttcatattttcttaataaaatctgtaccctgtccatcctccatattggcaccgtacatttttcattttttttaactgaaatttgtcccttgtgcattgcctccgctgtttttataataacaataacaaaagtttcgtcttccgcagtaaaccggcacgcgccaatgcggaaaccataaggaggaaaatcctctgctcgcttagggctcgcattttgctccgcaaaacaaggaggattgcatgaagttgttggaacgacaaagattatttcaaaaaccttcccgggaataccgtgggaagccgttctggtcatggaacggaaagctggaagaaaaagaactgaaacgccagattaatgttatgaagggaatgggcttcggtggatttttcatgcattcccgcaccggactggaaacggaatacctgggggaggactggtttcgtctgattaaccgctgcgcggactatggaaacaaaaaaggcctggaaacctggctttatgacgaagaccgctggccctcgggaagcgcgggcggcatggtgaccagggagccgcgataccgggccatgttcctggaaatgaatcagttttccccgcaggactggaaggattccctgcgcaccgcggatacagccgctgtttttgcctgccgcatcaaggatggtattttttcctccaaacgccgcctttctgagggggagcccctgcaggagggcgaaacggctgtggaattccgaacccgttactccgcctgcaatgacaactacaacggctactgctacgtgaacaccatgaaccgggaggctattgacaaatacctcgaaagcacccatgaaaaataccgggagcactgcggagacaagctgggcacaaaaatccaggggatttttacggacgagccccaccgcggaggtgttttcaccagcttcgcggaaggagaggtaaacgccgccccctacacccccggccttttcgaagaatttgaaaaacgcttcggctacagcctgctggaaaatctccccgaactattcctccgcagagaagaaaaggaactgtcccgggtaaaaagagactatttcgaactctgccagcagctgttcctggaatgcttcgcccggccgatctctgactggtgccgggaaaaccatctcatttttaccggccacgtactacacgaggattccctctgctgccaggccatcatgcagggctccctcatgcgcttctatgaatatatggactaccccggcatagacattcttgctgaaaacaatcaatgctactgggccgcaaaacaggtggattccgtggcaagacagctggataaaaaatgggttctctccgagctttacggctgcaccggctggcagatggattttgaagcctacaaaaatatcggcgactggcaggcgctgtttggcgtcaacctgcgctgccctcacctgtcctggtacaccatgaagggagaagggaaacgggattatcccgccagcatcctgcaccagtccgcctggtatcccgaataccactacctggaggactatttttccagaatccacgccgccctgcacggagcaaaagcggatgccgccctgctggtcatcagccctatcgaaagcgtatgggccagagcctacagcggcgcttttgacggccttacgggaaccgatcccgaaatacggcgtctggaagagcaatatgcctccgtcttccacatgctcaccggaaaccgcatcgacttcgactacggggaagaagatatcatggcccgccacgcacacgcggaaaacggaaccctccacatcggaagctgcacctatggcaaagtcctggtcgccggcgtggataccctgcgcagcagcaccctacggctcctgacagactatgccgcccagggaggcgccctgatttttgcaggaaatcccccagccttcgtggatgctctcccctccggggaggtcaaagccctagcctccgcctgcaccaccatcccgctggaggaaaaagcgctgacagaagcctgcgcaaacggccgggaaataaaaatagataccgaagacgcctccctgctgttcgcccgctcctaccggacagaaggcggccgcatgatcctgctcttaaatacggatcggaaaaaaggccgcgccaacgcagccctctgtctggggaccggaaaatacctggaacaatgggatccccgtaccggcaaaatcaccgaacccgaataccaggtgatcaacggccaaatccatctcaccattgatctggaagccggaggggagcgcctctaccgcattcccgcaaggaaacgccgcctgccgaaacaggaagcctttcggggaaccagaaccttccccctccccgacatcttccgctacaccctgtccgaaccaaacatctgcgtcctggacatggcagccgtcaccggcaaaaccggcctcagcctgccccccatggaagtgctcaaagccgaccgcgccctccgggaccatctccggctgccctaccgcggcggagaaatgctccagccctggtatcaggtaaaatacaaaggcggcagcacccggctgtgcgacaccattaccgtgacctaccggttccacatagacgccctgcccaccggaatttccctcgccctggaggatctggagcacatccgccgaatcctcataaacagccgggaaatcccccggaaaagcagcggcaaatggatagacatctgctttgacaaaattcccctgccagacgaagttctccgccccggagccaacaccatcactctggttatggactactacagcacctgcggtatcgaagccgtctacctcctgggagagttcggcgtaacgcttgccaataaccgccccaccctcaccaccctgcccgaaaccataaccataggcgacatcactccccagggccttcccttctattccggcgccatcacttaccacatagaaggcctgcaaaacaccctttgcagcgtaaccgcccccgactttggaggcgccctcctgaagctttccggaaaagaagaagtgcccctggcctttcccccgcacaaggctctcatccgggacctgaacgccatccggctgatcctcacccgccggaacaccttcggccccctgcaccaccctgaaaaacgccaatactcctactcccccgcctccttcattacagaacctccctgctggaccgattcctacgtcctctacgaacaagggcttttgaagaagccggagattttatactgaaagcctgcataccgtaaagccctgtatcacaggaagcgccgtatttttttacaatatacggcacttcctgtttttatttatacgctccgttcccggccgcacagtttttcatccttttttaagcctgctcatcaaaatatctgcacatatgcagtataatatccctgatccccgccatctccctctccggcggcaaaatatgattgcttacaaaataagcggccagcccgtctatctgcgaccaccataaccttgaaaaagcggcggcggcagcaggatcaacctccggtctgcttttaaggatgatttcctccaccatacccaggctgactctggctctttccttcattttttccctgagcgcttcgtttttcgaagcctccagccagaattcaaaattaatccgcgcaaaaaccagatcctcctgcgtccattgctttacactttcatcccagacacagattaatttttccgccaaagacatattatcggtaataacccggctcagcgcatccttaagagaaggattctccgtcagctcatcccaatgctccgccagcccgaaaaagatctcttccttactcttaaaataagtatataccaatcccttgctgatacccgcttcccttgtgatatcatcaatagacgtggcataatatcccttgctggaaaaaagccctaaagcggtttttaaaatatccttctgacgctgtttctttttttcttccgatatcttaggcactctgattcctccccatacattaattttgaagctgttccttttctcccgggctgctgtgaaaatccatcccaaatctcttgaagcgacggatttcggcgctcccggatcacttccgcagaccatatctcaggtatacggtgtacagcccttacatcgtgttacttttataactataaaccaatataacaattgtaataagaataatgcttccccctgatataaggtaaagctggctgatgctgaactgattaagcaccactccggtcagcatatacgaaaccggctgaagccctgccgaacacaaaaactgaatgcccatcacccttcccacaaggaaatcaggcgtaagctgctgaagtactgtaataaacagcacatttatgattcccaataaaagccctgccgcaaacgcggcgcccagaatcagcagccttgaagaaccgaagctgaaaacactccatacagcgcccagcgccagggaacaccacagtatcagccggatggactgcccgttctccctccgcttcatatttccaatgataacagcacttatcaaagaacccagccccgttatggacaacagcttcgtatatccgtccaccccttcgggcagacagttcatggccacgacaggaaatccgacctgctgggggccaatgacacacaaattcagaatggccgtaaagcccaataacaataataacacaggcagtttaaataaatccttatatgatccctgcacagctgcccgggagccttccggaacctccgcctgcccctgtttttccttatattttacccttgaaaaaagaaacagtgcggcaatggaggccaacgccattaacacataggcattatcgctcatttttccaatcacaattccggcaaaaagaggcccggccagcaatgacccctggctgatgaactgcatcactgaatttgccttctgcagatttcccccgcttaccagcgccggaaccgcagaataaagcgccggcaggatagccgcgctgattcctccaaacaaaaccgcatatataaaaacagtatatttatttaccgcatttacctgattcacaacagccagggaaaccagcaaaattcccaatatcccggtcccgcccgtaagcgtcctggatacccccgccttatccgtcaaaaatcccgcaaccggcagcagaaaaatcctcggcaccaccattgcagtcattaccgagcttagcaacaatacggaaccggcccccttcataattaatgatacctgcaaaacactgtataattggctgataagaaacaatatggtacacccgctgaaaaaaattataacattaacggacagaaactgcgatcttttgttctcaaacatactgcaatcctccttgaaataataaaaactgactggttagtttttattataccgctaatctataaatttgcaagtgtttttgttaacaacattctttcccctgccttttcataaactcaaatatccctgccaaaaaggcgctgcggaatttcttcaccgcaacgccttacattacacaatcatttaaaaatacctttttccgacggatatttcatcccaagcccggccccttgttccatttccgtatacagcccggaagaaatcgcttcatagcctgccagatatccccgggcggtaaacacaatcggaaccatctgatcctccaaaggcacctcatacatttcaaaaaatgcctgaaggatttccgtatttcttcccgacctggtgttgatcctgattatctgctgcggataggaaacgccgtccaccactacagtttccggaaataaatccagaacctccccgctggtcctgatacactcctcgcatacggtccgatagaaataaacaacagacgagctgcctttttccagcttataatcctcaagctgctgttttaacgtctcatttttagtgggatcatagacgcctctgccataaacaaataaatcctcccccgcagtcagataggcttcccggatggatgaacgaatggaatctgtcccaaaataaatatttccatttacagtcataatcgggtaagtgagagagcctgcaagttcttcctgaaaccccagttttttaagttcagaatcccttatctgcgcatcttctttgcgaaatacattataaacggacaccatataaggatacagttcggaaacatcatccagttcctccgatactatttcaaaaagctcttttgttccgtcgcaggaagcacagggctgattataaaaaaaatgtatttccacattttccggctgttcaggttcagcttctgcacatccggaaaggccaaaccacaaaagcatggaaaagaagcatataaaaaccttacgcatatttgtcaaaaatctgcctccgttaaactgactgacattccctctttgaggatgacttttttcttcctgcccttatagcagacagtcatctccctttcctgctgccttgttcccttcagctctgctttttcaagcctgccctccctgaagtttatggcaacagttgccccggcgcgcgtacacagtccggaaaccatgcctgttcccaaagccctgggaagcgcaggaagcagagcaatctcattttctgtgctttgcatcagcatttccgcaatgcctgcgcaggaaccgaaattggaatcaatctggaacggaggatgtgcgccgaacatattgggataacaccctcctccctgccggtaattcatgggatcgcttccgtccacaggacgtaattgctttttcagtatactgtaagccttttccccattgtgcagatgggcccacagcgccaccctccaggccagcgcccatccggtgctttcatcccctctcagttcaagcgtccggcggcaggcctctgccagttcaggcgttttctccacggaaatctgcctgccgggataaagagggtaaagatgggaagaatgcctgtgtgtcggctcgttttcctccaactcttcattccattcaagtaattcgccgcgtgatcctatccgatactccggaagacgttcaagcgccgcttccgtttctgcaagaaattcctgatctgtctccaataaccggcagcaggccgcagcattccccaatgtttcccggataattgccatcgtcatcgtggtcgtctgactgaccgcgcatggtttgccgtgatagacaaactgattctccggcgaagtggaaggtgcaaaaatcagtttaccatcctcattttcaacaaggacatccaggaaaaaccgcgccgcatcccggataatgggataacctgtctggcgcaggaaatccaaatctcccgaaaaaaggtaatgatcataaacatgcgcgcttaaccagcctgccgacagaggccagaaggcatacactgccgtacccttcccccggtttcccaccggagtggaaagacaccatatatcactgttatgatgcgatacaaaccctctggcattataatggatttcagctgtttttcctccgctgaccctcaggttattaatcagctccattaaaggctcatgcatttccggcagattcaccgtttccgctccccaatagttcatttccgtattgatattaattgtataattggaactccatggggcgcgcatatgctgattccagattccctggagatttgccggctgcgttcccggccgggaacttgaaatcaaaaggtaacgcccatactggaaaagcagggcatagcgcccgggatccacatccttttcccagtcggcgagccgttgtggaatcggcaggtcttctcttcccggccccaggtcaaggcagaccctgttaaaatactgctggtattccttcacatgccgttccagaagcctgtcataccccgacttctgtgcggcaagcagttccctgaaacaaggttctttataaggttttccctccaggaacggatgcctgaacggaccgttaaagcttgtccgggcggccagaaacagtgtaacgctgtccgcattgcttacttccagtccctccggcagcctttttacttccccgcccacaggctcaatcgctaataccgcacaaaaccgcattcctttcttttccggagcttcctcataaataaccggatccggagaatcaacataggatggatccacctgtgagggagcgattccgtccaggatcattctgttttcttccgtggatacttctgcccgaagctggcaggaaaaacctgctttcagggaaaccatgccgggcctgtcggctgaaatgtgcatcaccataacctgatccggcgcactgacgaacatttcccgcacgtaatttaccttccctgccgaatactgcagtctggaaagcgccttcccaagatccaatgaccgacggtagttttggatctcaccctcaggatggaccatatccaaggtcagttcacccaacggcagatagctctgtgtgaattccccaagcacattctgttcaaggagcgcctgcgcctcttcatatttcttttccatggccagccggcgtgcctgcctgtagtattccgatgctccgggaatatcgtggttctggggataacctgaccacagcgaatcctcatttaacgaaattttctcctgctttgtccctgaccataccattgcccccagccttccatttcccagcggaagcgcttcctcccaataagacgccggttctttgtaccataattccataatctgtgtcccttccttccctaaacctaagaacaaatatctgtaactaaaaaacagccaggctccggagtttcccggaagcctgaccgttttaaccgttttatctgccggcagctgtcttatatatttcaatatagcgatcaactctgtaagaatcaagttcactcagatactgatcccaaccggtttcgatgtcacgctcacctgtaataaactgaacggtagccatacggacaaagctattcaggttcgtctgaatctcagcatagtcatctgccatgtccagaggaataaataccgtataatccagtctttccttcggaatatactgttctaccttctgggtatcaagagtaatacgctgttcatagtttccgggctgataaatatcatccacctcgggaagcatggaaaggcggaaaggagccaggtcagcctgcggtcctaccatcatcgtgcccttactaatctctgcattctgatcttctgtaagagagtttacaatatatctggcatcaccgccaaatacgttcttggttccttcaggacaataatcccagccaagacctctttccccatacttacgttccatattataatcatcatcatagaagaactcatcgatcaaacggaaagctgcttccggatacttacaggcatctgtaattaccgcatggaatccctgtacttcaccttcattcgcattctgtccctgacgtctgaagccatccggccctgccacgggaatcaggatctgataattttctgcttctacaggatcattattgtcataacccataccagcatgatcgcagacatacattccaaccacatggggttctgtcctgactgtctgtgccagctgatcctccttctgggtaaaggaagcaccatcaatcagtccttcatcataaaggctcttaatataacgcagaccttcacggtaagcatctgtagaaggagaaaattccacagattttccatcagcgcccaggctgagccagaaatcaggttttactgtctggaaagacatacccatcaatgcgtattcaaccatcgtattccaggtagtggcgccgagcataccgatttcgtctttctttccgtttccgttaggatcatcgtttacgaaagcccttaatacttctctcagctcttcggtagtttcaggcattttcagccccagcttatccatccagtcctgacgcagataaatcttgggatatgcgctgcagtggtagcactccgagaaacgtgcaaatccataaatttctccatccggtgcaacacatctgtccctgtagctgggattatactcaaaaatacgcttcatattgttgccatacttatcaatataatccgtaatgggaagcaggaccccttccttcaccccatactgcataatatccgactttgtaaataccgtcggccagtcagtcagaataagatccggataatccccgctggccagcatcagatttctcttctggagcgcatcggaaagaggagttgaaataatctgaagcttgatattggatttttcttcgatctcttttacaaaccggttttgttcccaatcaatatccgccccgccttcaatccataccttcagtgtgattttctcattcatgatcggcatgccggtagcgttaaagccttccggtaaggaggtatctcccgcctcagctgctgcatttgcaccttctcctccgcctcctcctgtattaccagcagcggtttctttccccccggatgaacatcctgccatgcttattaccatacatgcggataacagcaaggccaacacttttttcttcatagaaccttttcctcctttttatttattctgacaccccactcttttcccgaaaatgaaatgttcagatcacaacccaacaagtctcaccccttaatcgcccctaccataattccttttacaaaatatttctgaacgaaaggataaagcagcataaccggcacagaaccaacaataatacttgaatactgcagcagatattttgtttcctgcatctccagctgtttcgtaacatcaagcgtcatacctgccgtgcccatattaaccaggatttcccgcaggacaagctgcagagggaacttggtattcgtactcagatacatcatttcgttaaaataagaattccagtggcctaccgcatacagcaggacatttactgccagaatcggctttgcaagaggaattgcaattttaatcaggaaggtaaaatcatcgcagccgtccacgctggcgctttcctgtacttccccgggaattgtggactggaaataggtacgtgtaataatcaggttccagaccgaaatagaggtcggtattaccagtgcccagatggtgtcaagcattcccaggtttttaatcagaatataggtgggaatcataccgccgttaaaaagcatggtaaaagtgaacaaaagcataaccggattacggatcgccagatccttacgtgacagcggataagccgccagtaccgtcataaccaggttaatcacagtacccaccaccgtatataaaagggagttgcaaaatccggttacaagcagttcatgctttaaaagcattttataaccacgcaatgtaaaatccacaggcaccaggaaaaccctgcccgaaagaagtgctttcggcgacgaaaaagaggccgccacaacataaatcaatggaatcaagatgcatattacagatacggcgcacaaaatatgcacaagcaccatgtatatgtaatccttcggtttcgtataataccggacagacatatttttcttttttattgtctttgccatagccgcctccttaccacaagctggtctcgtttacttttttcgaaaacatatttgcaagtactatcagaaccagattacatacggaattgaacaatcctactgccgtcgcatatgaatactggaaattgataagaccacgcttataaacaaaagtggaaataatctcggaaaactgcatattcaccggattctgcatcagatataccttttcaaatcccaggctcataatactgcctaccgccagaatcagctgaattacaattgtcggcataatcgcgggaatatctacattccacactcttgcgaaacggcccgcgccgtcaatgatcgccgcctctacctgggaagtatcaacactcgcaagtgccgcaatataaataaccgcgctgtatcccattccctgccagacacccgaccatacatacaggcttctgaagagctccggttttcccatgaaatcaactgccgtccctcccagtgcagtaattatattattgaccagtcctgtcctgatcgaaaaaatattctgcatgatacctaccaacactactgtggaaatgaaataagggagataggtaaccatctgaacgactttcttataatgccgcccccgcatttcattaattgccaacgcaaggaggataggcatgggaaagctgattacaaggctgtacaaactgagtgcaagcgtatttctcatcaaaaccttgaaatccggtgtggtaaagaaatttttgaagtgttttaatcctacccagtcgctcccccagattccaccccggatagaatagtccttaaacgcaataaccgccccgcccatagggagataggcaaaaataatcagataggtaacaggcaaaatcaacatcacatataactgccagtgcctttttacctccgtagatatccttttccccaaacttttcttggcattcggctggtttaacataaccgtcccctttaccctggtagctttcaccgccatatatatttcctcctccctaccaaatgttaattgttatatatataattagcatcctacatgtgctttgtcaagcagaatatttatgcaatctgcactaataatttttatttttagccttcaaactattagaatcaaatataggtttctattcttgacaccaaaacctttggatgatattattaacaaaaagtaaatcgtttaattttttatgaggagtattactatgcctgctacgctgaaggatattgcaaaagaaaccggcctgagcaccgccaccatatcgaaatatctgaacggcgcaaaactccgcgaaaagaaccgcattgccatcgagcaggcgatacataagcttgattatactgtgaatgagtatgcccggggatttaaactgaaccggtcacatattatcggggttatcattccggatctgaataatctttttataacaaacattcttgtccaaatggagactctcctccgggagcatgattacagtatcatgatctgtgactgccatacggatgccgctcttgaacgcagtcttgtacagtttttgttagggagaatggtagacggtatcattaacatgcccgtatgtacaacaggagaacatttaaaacctgcattatcgaaaaaggttcctgttcttgtactggatcgtatgatatccgggctggaagggcagatcgacaatattctgattgacaatacctgcattgcccgcaaagccgttcagagccttatcgaccaggggcaccggcagatcggcctgattagcggtcccactgactattccacctcacgggaacgtctggaaggctatcggcaggcattagcgtcctccaaaatccccctaaatgacagccttattgtctgtggtgattttactctggaaggaggatatgaaggtatatgccgcctgctaaaaggcaatccgaatatgacggctgtctttcccacgaattacgatatgacactgggtgcctttattgccctgaaggaacagaatatccggattccagaggatatttcctttattggtttcgatgatatggggctggccagagtaacgcatccccctttaactatagtcgcccaaccgcttgaacagcttggaatttatgcggccaaacgtattctcagcagattggaaaatccggaggatgttccaatttctatcacgctttccgcatcgcttaagccgggttcctccataggcgtcccccgccacgtagaagatgagtgattaaaaaagcagcataaaaacgacgtttttccaggcttttatggcaacaaaaaaacggcagctaacctgccgttttttattttaaataaagagggtacaaccctgttgtttgaaatgctctattttctgatcaatcagctccaccggcacatccagccgtccggccaggcaccttttacacaaaaactccgccgcgcccctgttcacgaactttttatatgcgccgatttcattgtaggtaagctctttaccgcattgaaagcacgcggacattatagatcaaccacctttgcccggaatacctcgcagtcaaacggtgcaagctccctggaaacagtggcgttcttcactttaatgcactcgccgctccacacttccttcatctccagtgtttttcctgtagaaaagcccaggcccacttcatccaggttaaatctggcaaccgccttttcctcactcatattgaacaggccaatcgcaagatccccgttttccagctgccttgcataaatgagcatatcgtccccggcccagattccctgcagcttgtaggcctgacggcaggcgctgtcctggttgatacggatcagctcttcatttcccagaatcttcttcgtttcctccgtcatactgcgcacatcgcagccgatcatcagcggtgagccaagcagggaccagatggaaaaatgtgtcttgtactgcacgtcgctgcagcccttcaggcccacatttccattgccatacatgccaacgatcagcatgtccatatcattgaagcagcccacgccattataaggatgcagcttctcctgctgctttaccagatcctttacggactcccatgtatcgaagatatccccggtagaacgccacatggaggctgcggaggtcttgatccactcatgggtctgatccgctccccaggaacaggcgctgaagaggatatcacggccgcagttttccagggcaagccccatgcgtctgtacaggtactgcccatgaatgatagggctgtgatagcagtaatcatatttcaggaaatccacgccccactgcgcgaatgtctccgcatcgatgaactcatgctcaaagcttcccggataaccggcgcaggtcaggttcccggcgcaggaatacataccgaatttcagccccttgctgtgcacataatccgcaacagccttcatgccattggggaatttcccaggatccggcacaagcctttctttttcatccctctcacgcagggaccagcagtcgtcgatgaccagatattcatagcccatccggggaagccctgcttccaccatcgcatccgctgtctcaaaaatcagtttttcattgatgttctctccaaaggtattccatgaattccagcccatgggcggcgttaatttaaccatactattgacctccaaattcctgttgggttattatgtagctgtgcgaaaggctgtgtaaatgccatgcgttctgtctgcggcggggatcgggagccgctggaaaaccgccccgccgatccccgccgcagacagaacgcacggcatcgccgcaggcttcagacatttttattatagaatggattttaagaacatttccatataatttggttgcaaaagcatgtacttttcgttcattttggaagattcaaaaatgaggaagggagggttgaccttggaagggtattcggaggaaacggtgcggcttgtggggtatggccgggaggattgttcggatctgcattcctgggggccaggggtcagggctttttatattattcattatgtgatccggggcgcggggtttctggagtgcggaggaaaacggtttcggattacggcgggggagagcttccttttgtacccttatacggagcttttttattatccggacccggaggatccctgggagtatacgtgggtggattttacggggaaggagatcgggcggctattgtcacgtaccggattctctttctcctggccggttgctcctgtgattggtgcagaggatattcttcctttgtttgacaggcttgggcggctggattttctttcccggggaaagggggaggcaaacgggcttttgctggcgattcttggtgtttacggggatatttttccggcgccgcaggttcccgcccgtaaggaggatgatcggctgtccaccgcgctgctgctgattcagggtaattatcataaggcggactttaacgtggagcggctctgcactgccatgcatgtgaaccgggtcacgctttaccgtcttttttccggaaaactgggggtgtctcccaatgggtatatttcccattaccgtctggagcaggggaaaaagcttctggagatgggcttctccgtgaaaaacacggcgctttcctgcggcttttccgatcccttttatttttccagggcctttaaggcgtatacgggaatggctccggcggcctataaagcggggccgccgcaaatcagctgaaaccagctgtcccggatatacaagtgcgtaatccttccaatataatcttaccattcatttccgcctggctgaatcacataaaatgaacatctgcagggagcttccgccggccgtaaccaaccggccgacagaagctccctgtttttattctatttcacagttgttttattccgtatatttttatatttaattttggcaaaacatcggcaaaaattttcaataaccggcaaaaaaataaacgatgggataactttttccagtattttacaattcaattgactataattttcggatggattacaatagatttaccaaaaattggtagtagaaactctggtaactatgtgcatggaagggtacggcaaaccagtaatacagcaaagattatccgtccgggacagggaggaaaatcctctgccctcaggaagcccgcttttgctttgcaaaagaaagagaatttcgtcaacggataaaagggggagctctatatggcatggtattccggtactttttattgtgggcatgaaggctacataaacattatcgggcctctgaagaacagggaaaaaatgagagagtacaagttttccggcctctgcccggcatgctgcagggaagcgctgctgcaaagccggaacgagcagaacgccgccgccaggaaggcagccgcccgcatggagctgccgccgcttgagggcagccggaagcaggtgacctgggcggaaactctccgcgtggaagcgctgacccgtctgcaggcctttatcgataacccgcggaatgtcgatctggtcgtcaggcgtatgacctacgaagcgctgactcccatcgaattaaatgccggggaacttcctgtgatattccaggaaatcgtccaatatctcattcatgaaaaaacaaaggcagcctactggattaacaaccgtttcaataaggatctgtgcaacctggagcagcttcttcccgaatatctggaatggaagaaatggtgccgccctgaggaaagcagcgccgatcccggctttatttccaaggattccattattgccccccatgctccgcagtacgccggcatcgtggaaatcaggggggatgacagcgagatcctggccatttatgagaaaaacgaccgattccgggaaattatccgggatatggattatgaatggaacggaagctgctggtaccgcaggctgaatgcctgccgcggccgtttttgcgaccgtgccgccgaacttggcaatcttctgctcaaaaacggcttcaccgtatccatagcggaccgcgaagcccgtgaacaggccattaccggcaattttcttcctgaacataaacgctggatcagcaaaagcaaaaaaggcagcttcttttacattgccatatcgcccaatatgcccagggaaatctctgtgaacctgaaaaaaatacccacctccaacttccactccggcggcatcttcctggagccgtcgcattatgaggaactggaggattttgcggaaatgtacggattccgctttgatccggaggccagggagcttcttgagtcctacagattgactctggacagcgcgccccgcgtatccccggcgcctccaaaaccgacggaagatatcaacaacctgcacaaaatactggaatcctccggagccattctggatgatctggcggatagtgactgattatgcatttgacaaacaagctcctggactaccaggagaatgcggtagaaaaattgaaaaaggtcaaggtgggcgccctgttcatggaacagggcacaggcaaaaccatcactgcgctggagctttgccggctccggctgaaggccggaaaggtcacccacatcctgtggctctgcccctgttccaccaagcagaacctgaaggatgagctcatcaagcagtccccccgggaaatgcttgagaaaattaccatatgcggcattgagacactttcccgaagccttcatgccaacagctatctccagctgctcactgaacgggaagcctgctacctcgtggtggatgaaagccttcttattaaaaatccctacgcctacaggacacagaacatagaccggctgtcctcacgatgcgaatacaagctgattctcaacggcatgcccatttccaaaaaccaggccgacctgtatgcgcagttccatgtgcttgactggaggatcctgggctataaaacctactggtccttcgccgccaaccacattgaatttgatccggaaattccgcagaaaatcatccgttgtctgaatacggattatcttgccagaaaaatatccccctacaccgtgcaggttaccaaaaaggactgcctcgtgcttcctgataaaagatataccattaactactttccgctcaccccggaacagaacgcccattacaacagcgtggccgacaccctgctgtttcacctcaacgaaatgcatcctgagacaatataccggctgttttcaggtctgcaggccgtaacaagcggcttccgtgtgaacttccgcaaaagcgcagtatccggctatgagcatatcgtaacctcgcccttttttgcggagcctacggataatccccggctgcagcgcctgcttaccgtacttgacaaccggaacaaatacatcattttctgcaactatacctatgaaatcgatgtgctgtgtgaaatcctttccagaaaatacggcccggaaaacgtggcgcgctttgacggttcccttcctatgaaaaaaaggctccgtaacctggaggaattcagggaatccgccaccttcctcattgccaaccgggactgcgcgggctacagccttaacctgcagttctgccataatatcatctactattccaacggctgggatctggccacccgcctgcaaagcgaggaccgtatccaccggatcggccaggatcaggacatccgcatccgggatatctgtgcctataacaccctggatgaaagaatcctcagctgcctgtacaggaaggaaaagcttctggaagccttcagaaacgacattaaaaacatggaaaacaaaaatggaatcgcggaatgggtattttaccggcagccaagccggagcctgatggactgcgatgatttggaggaaccccgccatgcctaaaatataccgggataaaaacgtatatgaagccgctatggagcggtacgatatcatttataaaaatttcgatcacatttatttcagcgtttccggaggaaaagacagctccatcatgctgcagcttgccgccggcgccgcccgccggaccgggaaaaaaatctcagtcctctacattgatctggaggcccagtaccaggcaaccattgaccacgtggacgagcttatacgctgtacggcggatgtggtggacgcctggtactgggtagccatgccgctatccctgcgaaacgccgcttccgccatccgccccaaatggatctgctgggataagaaacagaaggaaaaatgggtgcgcccccttcccga
